US011160869B2

(12) United States Patent
Maclean et al.

(10) Patent No.: US 11,160,869 B2
(45) Date of Patent: Nov. 2, 2021

(54) COMPOSITIONS, FORMULATIONS AND INTERLEUKIN PRODUCTION AND PURIFICATION

(71) Applicant: Applied Molecular Transport Inc., South San Francisco, CA (US)

(72) Inventors: Derek Maclean, South San Francisco, CA (US); Randall J. Mrsny, Los Altos Hills, CA (US); Kevin Yin, Palo Alto, CA (US); Tahir Mahmood, Burlingame, CA (US); Bittoo Kanwar, San Francisco, CA (US); Sally Postlethwaite, Redwood City, CA (US); Weijun Feng, Danville, CA (US); Sean Dalziel, South San Francisco, CA (US); Hyojin Kim, San Carlos, CA (US); Rajendra Tandale, Atwater, CA (US); Marvin Garovoy, Sausalito, CA (US); John Koleng, Austin, TX (US)

(73) Assignee: Applied Molecular Transport Inc., South San Francisco, CA (US)

( * ) Notice: Subject to any disclaimer, the term of this patent is extended or adjusted under 35 U.S.C. 154(b) by 0 days.

(21) Appl. No.: 17/169,390

(22) Filed: Feb. 5, 2021

(65) Prior Publication Data

US 2021/0154304 A1 May 27, 2021

Related U.S. Application Data

(63) Continuation of application No. PCT/US2020/046545, filed on Aug. 14, 2020.

(60) Provisional application No. 63/055,886, filed on Jul. 23, 2020, provisional application No. 63/033,077, filed on Jun. 1, 2020, provisional application No. 63/020,996, filed on May 6, 2020, provisional application No. 63/013,309, filed on Apr. 21, 2020, provisional application No. 62/986,579, filed on Mar. 6, 2020, provisional application No. 62/986,557, filed on Mar. 6, 2020, provisional application No. 62/971,126, filed on Feb. 6, 2020, provisional application No. 62/970,627, filed on Feb. 5, 2020, provisional application No. 62/939,495, filed on Nov. 22, 2019, provisional application No. 62/898,729, filed on Sep. 11, 2019, provisional application No. 62/898,899, filed on Sep. 11, 2019, provisional application No. 62/898,934, filed on Sep. 11, 2019, provisional application No. 62/898,709, filed on Sep. 11, 2019, provisional application No. 62/888,237, filed on Aug. 16, 2019, provisional application No. 62/888,144, filed on Aug. 16, 2019, provisional application No. 62/887,933, filed on Aug. 16, 2019, provisional application No. 62/887,963, filed on Aug. 16, 2019.

(51) Int. Cl.

| | |
|---|---|
| ***A61K 47/34*** | (2017.01) |
| ***C07K 14/54*** | (2006.01) |
| ***A61K 47/32*** | (2006.01) |
| ***A61K 47/38*** | (2006.01) |
| *A61K 38/00* | (2006.01) |

(52) U.S. Cl.

CPC .............. *A61K 47/34* (2013.01); *A61K 47/32* (2013.01); *A61K 47/38* (2013.01); *C07K 14/5428* (2013.01); *A61K 38/00* (2013.01)

(58) Field of Classification Search

CPC ........ A61K 47/34; A61K 47/32; A61K 47/38; A61K 38/00; C07K 14/5428

See application file for complete search history.

(56) References Cited

U.S. PATENT DOCUMENTS

| | | | |
|---|---|---|---|
| 2,643,653 | A | 6/1953 | Heidrich |
| 4,414,148 | A | 11/1983 | Jansen et al. |
| 4,458,066 | A | 7/1984 | Caruthers et al. |

(Continued)

FOREIGN PATENT DOCUMENTS

| | | | |
|---|---|---|---|
| CN | 101522214 | A | 9/2009 |
| CN | 102227447 | A | 10/2011 |

(Continued)

OTHER PUBLICATIONS

BR11-2013-006088-3 Office Action dated Apr. 13, 2021 (w/ English translation).

(Continued)

*Primary Examiner* — Sean M Basquill

(74) *Attorney, Agent, or Firm* — Wilson Sonsini Goodrich & Rosati

(57) ABSTRACT

Described herein are cholix-IL-10 fusion proteins, and methods of use thereof, which can be characterized by a distinct response in an individual when administered. This distinct response can comprise changes in levels of one or more markers in the individual and/or co-localization of IL-10 in the lamina propria of the individual. Further described herein, in some embodiments, are oral formulations of the cholix-IL-10 fusion proteins. Described herein are methods for the purification of an IL-10 delivery construct, including methods for refolding and enrichment, which can result in maintenance of a high percentage of the IL-10 delivery constructs in the biologically active dimer form. Described herein are oral formulations configured for site-specific release of a therapeutic protein in the small intestines or colon. In some cases, the therapeutic protein is in the form of a dimer, such as an IL-10 delivery construct capable of crossing the gut epithelium.

25 Claims, 182 Drawing Sheets

Specification includes a Sequence Listing.

(56) References Cited

U.S. PATENT DOCUMENTS

| | | | | |
|---|---|---|---|---|
| 4,569,789 | A | 2/1986 | Blattler et al. | |
| 4,659,839 | A | 4/1987 | Nicolotti et al. | |
| 4,671,958 | A | 6/1987 | Rodwell et al. | |
| 4,680,338 | A | 7/1987 | Sundoro | |
| 4,683,195 | A | 7/1987 | Mullis et al. | |
| 4,699,784 | A | 10/1987 | Shih et al. | |
| 5,272,065 | A | 12/1993 | Inouye et al. | |
| 5,328,989 | A * | 7/1994 | Vellekamp | C07K 14/5428 530/351 |
| 5,512,658 | A | 4/1996 | Pastan et al. | |
| 5,589,384 | A | 12/1996 | Lipscombe et al. | |
| 5,602,095 | A | 2/1997 | Pastan et al. | |
| 5,668,255 | A | 9/1997 | Murphy | |
| 5,696,237 | A | 12/1997 | Fitzgerald et al. | |
| 5,710,251 | A * | 1/1998 | Vellekamp | C07K 14/5428 530/351 |
| 5,807,832 | A | 9/1998 | Russell-Jones et al. | |
| 5,863,745 | A | 1/1999 | Fitzgerald et al. | |
| 5,917,021 | A | 6/1999 | Lee | |
| 5,922,680 | A | 7/1999 | Fjellestad-Paulsen et al. | |
| 5,965,406 | A | 10/1999 | Murphy | |
| 5,997,856 | A | 12/1999 | Hora et al. | |
| 6,007,791 | A | 12/1999 | Coombes et al. | |
| 6,022,950 | A | 2/2000 | Murphy | |
| 6,051,405 | A | 4/2000 | Fitzgerald et al. | |
| 6,086,918 | A | 7/2000 | Stern et al. | |
| 6,133,229 | A | 10/2000 | Gibson et al. | |
| 6,174,529 | B1 | 1/2001 | Michael et al. | |
| 6,251,392 | B1 | 6/2001 | Hein et al. | |
| 6,255,284 | B1 | 7/2001 | McGregor et al. | |
| 6,391,296 | B1 | 5/2002 | Okano et al. | |
| 6,440,419 | B1 | 8/2002 | Hein et al. | |
| 6,488,926 | B1 | 12/2002 | Khan et al. | |
| 6,525,102 | B1 | 2/2003 | Chen et al. | |
| 6,573,237 | B2 | 6/2003 | Rinella et al. | |
| 6,592,847 | B1 | 7/2003 | Weissleder et al. | |
| 6,613,332 | B1 | 9/2003 | Michael et al. | |
| 6,673,574 | B2 | 1/2004 | Stern et al. | |
| 6,759,207 | B2 | 7/2004 | Weber et al. | |
| 6,838,553 | B1 | 1/2005 | Hwang et al. | |
| 7,053,200 | B1 | 5/2006 | Zoghbi et al. | |
| 7,193,055 | B2 | 3/2007 | Daugherty et al. | |
| 7,544,361 | B2 | 6/2009 | Arakawa et al. | |
| 7,611,714 | B2 | 11/2009 | Mrsny | |
| 7,666,991 | B2 | 2/2010 | Mrsny | |
| 7,713,737 | B2 | 5/2010 | Mrsny | |
| 7,824,695 | B1 | 11/2010 | Fitzgerald et al. | |
| 7,964,200 | B2 | 6/2011 | Mrsny et al. | |
| 8,309,102 | B2 | 11/2012 | Mrsny et al. | |
| 8,637,646 | B2 | 1/2014 | Wells et al. | |
| 8,853,160 | B2 | 10/2014 | Greig et al. | |
| 8,877,161 | B2 | 11/2014 | Yu et al. | |
| 8,889,619 | B2 | 11/2014 | Bai et al. | |
| 8,993,295 | B2 | 3/2015 | Seed et al. | |
| 9,012,398 | B2 | 4/2015 | Lau et al. | |
| 9,023,397 | B2 | 5/2015 | Pierce et al. | |
| 9,090,691 | B2 | 7/2015 | Mrsny et al. | |
| 9,181,305 | B2 | 11/2015 | Haack et al. | |
| 9,259,456 | B2 | 2/2016 | Kidron | |
| 9,265,723 | B2 | 2/2016 | Sprogoe et al. | |
| 9,956,172 | B2 | 5/2018 | McGinity et al. | |
| 10,130,688 | B2 | 11/2018 | Mrsny et al. | |
| 10,143,726 | B2 | 12/2018 | Oft | |
| 10,617,741 | B2 | 4/2020 | Mrsny et al. | |
| 10,617,767 | B2 | 4/2020 | Mrsny et al. | |
| 10,624,955 | B2 | 4/2020 | Mrsny et al. | |
| 10,624,956 | B2 | 4/2020 | Mrsny et al. | |
| 10,624,957 | B2 | 4/2020 | Mrsny et al. | |
| 10,786,555 | B2 | 9/2020 | Mrsny et al. | |
| 10,786,556 | B2 | 9/2020 | Mrsny et al. | |
| 10,799,565 | B2 | 10/2020 | Mrsny et al. | |
| 2003/0186386 | A1 | 10/2003 | Hansen et al. | |
| 2004/0219240 | A1 | 11/2004 | Babish et al. | |
| 2005/0281885 | A1 | 12/2005 | Egilmez et al. | |
| 2007/0196371 | A1 | 8/2007 | Kuestner et al. | |
| 2008/0317761 | A1 | 12/2008 | Cines et al. | |
| 2009/0092660 | A1 | 4/2009 | Mrsny | |
| 2009/0142341 | A1 | 6/2009 | Pastan et al. | |
| 2009/0148401 | A1 | 6/2009 | Mrsny | |
| 2009/0155297 | A1 | 6/2009 | Mrsny | |
| 2009/0305978 | A1 | 12/2009 | Zane | |
| 2010/0143420 | A1 | 6/2010 | Shenoy et al. | |
| 2010/0143481 | A1 | 6/2010 | Shenoy et al. | |
| 2010/0151005 | A1 | 6/2010 | Muro-Galindo et al. | |
| 2010/0196277 | A1 | 8/2010 | Desimone et al. | |
| 2011/0130331 | A1 | 6/2011 | Guyon et al. | |
| 2011/0250199 | A1 | 10/2011 | Fitzgerald et al. | |
| 2012/0258104 | A1 | 10/2012 | Echeverri et al. | |
| 2012/0276190 | A1 | 11/2012 | Fitzgerald | |
| 2014/0065172 | A1 | 3/2014 | Echeverri et al. | |
| 2014/0206608 | A1 | 7/2014 | Haack et al. | |
| 2014/0206609 | A1 | 7/2014 | Haack et al. | |
| 2014/0213513 | A1 | 7/2014 | Haack et al. | |
| 2014/0221281 | A1 | 8/2014 | Haack et al. | |
| 2015/0030675 | A1 | 1/2015 | Zhou et al. | |
| 2015/0164997 | A1 | 6/2015 | Haack et al. | |
| 2015/0216981 | A1 | 8/2015 | Bley et al. | |
| 2015/0265718 | A1 | 9/2015 | Mrsny et al. | |
| 2015/0265719 | A1 | 9/2015 | Mrsny et al. | |
| 2016/0068583 | A1 | 3/2016 | Van et al. | |
| 2016/0263020 | A1 | 9/2016 | Yan et al. | |
| 2016/0287670 | A1 | 10/2016 | Van et al. | |
| 2017/0015747 | A1 | 1/2017 | Thompson et al. | |
| 2017/0273909 | A1 | 9/2017 | Mathiowitz et al. | |
| 2017/0362291 | A1 * | 12/2017 | Chan | C07K 1/113 |
| 2018/0028614 | A1 | 2/2018 | Huang et al. | |
| 2018/0180630 | A1 | 6/2018 | Monteleone | |
| 2018/0318230 | A1 | 11/2018 | Chopra et al. | |
| 2018/0353610 | A1 | 12/2018 | Mrsny et al. | |
| 2019/0015441 | A1 | 1/2019 | Shachar et al. | |
| 2019/0105375 | A1 * | 4/2019 | Mrsny | A61P 1/12 |
| 2019/0177388 | A1 | 6/2019 | Scheer et al. | |
| 2019/0255107 | A1 | 8/2019 | Kuchroo et al. | |
| 2019/0257832 | A1 | 8/2019 | Ulsemer et al. | |
| 2019/0290688 | A1 | 9/2019 | Bar-Sagi et al. | |
| 2019/0336582 | A1 | 11/2019 | Moustakas et al. | |
| 2020/0140511 | A1 | 5/2020 | Porat et al. | |
| 2020/0306383 | A1 | 10/2020 | Porat et al. | |

FOREIGN PATENT DOCUMENTS

| | | | |
|---|---|---|---|
| CN | 103249401 | A | 8/2013 |
| EP | 0188256 | A2 | 7/1986 |
| EP | 1522585 | A1 | 4/2005 |
| EP | 1450855 | B1 | 8/2009 |
| EP | 1379273 | B1 | 9/2009 |
| EP | 3402810 | A1 | 11/2018 |
| EP | 3474884 | A2 | 5/2019 |
| EP | 3554346 | A1 | 10/2019 |
| EP | 3554541 | A1 | 10/2019 |
| EP | 3600378 | A1 | 2/2020 |
| EP | 3610862 | A1 | 2/2020 |
| EP | 3668544 | A1 | 6/2020 |
| JP | 2008515808 | A | 5/2008 |
| KR | 20140014068 | A | 2/2014 |
| WO | WO-9212726 | A1 | 8/1992 |
| WO | WO-0187925 | A2 | 11/2001 |
| WO | WO-2004007549 | A1 | 1/2004 |
| WO | WO-2006044205 | A2 | 4/2006 |
| WO | WO-2008021234 | A2 | 2/2008 |
| WO | WO-2008122967 | A2 | 10/2008 |
| WO | WO-2009014650 | A2 | 1/2009 |
| WO | WO-2009026328 | A2 | 2/2009 |
| WO | WO-2009115531 | A2 | 9/2009 |
| WO | WO-2009149281 | A1 | 12/2009 |
| WO | WO-2010040105 | A2 | 4/2010 |
| WO | WO-2012036746 | A1 | 3/2012 |
| WO | WO-2012101235 | A1 | 8/2012 |
| WO | WO-2012110596 | A1 | 8/2012 |
| WO | WO-2013003824 | A1 | 1/2013 |
| WO | WO-2013130913 | A1 | 9/2013 |
| WO | WO-2014094176 | A1 | 6/2014 |
| WO | WO-2015070060 | A1 | 5/2015 |
| WO | WO-2015113005 | A1 | 7/2015 |

(56) References Cited

FOREIGN PATENT DOCUMENTS

| | | | | |
|---|---|---|---|---|
| WO | WO-2015171965 A2 | | 11/2015 | |
| WO | WO-2015171965 A3 | | 3/2016 | |
| WO | WO-2016146833 A1 | | 9/2016 | |
| WO | WO-2018044920 A1 | | 3/2018 | |
| WO | WO-2018067401 A1 | | 4/2018 | |
| WO | WO-2018106895 A1 | | 6/2018 | |
| WO | WO-2018175340 A1 | | 9/2018 | |
| WO | WO-2018183931 A1 | | 10/2018 | |
| WO | WO-2019036243 A1 | | 2/2019 | |
| WO | WO-2019036382 A1 | | 2/2019 | |
| WO | WO-2019089603 A1 | | 5/2019 | |
| WO | WO-2019173787 A1 | | 9/2019 | |
| WO | WO-2019183449 A1 | | 9/2019 | |
| WO | WO-2019193204 A1 | * | 10/2019 | ........... A61K 9/0031 |
| WO | WO-2020023389 A1 | | 1/2020 | |
| WO | WO-2020096695 A1 | | 5/2020 | |
| WO | WO-2020097394 A1 | | 5/2020 | |
| WO | WO-2020144164 A1 | | 7/2020 | |
| WO | WO-2021034727 A1 | | 2/2021 | |
| WO | WO-2021034728 A1 | | 2/2021 | |

OTHER PUBLICATIONS

Capra et al. Predicting functionally important residues from sequence conservation. Bioinformatics 23(15):1875-1882 (2007). Advance Access publication May 22, 2007.

Co-pending U.S. Appl. No. 17/235,567, inventors Mrsny; Randall J. et al., filed Apr. 20, 2021.

EP19717013.7 Office Action dated May 20, 2021.

Gray et al. Cloning, nucleotide sequence, and expression in *Escherichia coli* of the exotoxin A structural gene of Pseudomonas aeruginosa. Proc Natl Acad Sci, vol. 81, pp. 2645-2649 (May 1984).

PCT/US2019/050708 International Preliminary Report on Patentability dated May 11, 2021.

PH1-2016-502447 Office Action dated Mar. 12, 2021.

Aceves, SS et al., "Oral viscous budesonide: A potential new therapy for eosinophilic esophagitis in children," Amer. Journal of Gastroenterology, Oct. 2007; 102:2271-22799.

Aithal et al. Role of polymorphisms in the interleukin-10 gene in determining disease susceptibility and phenotype in inflamatory bowel disease. Dig Dis Sci. Jul. 2001;46(7):1520-5.

Aksentijevich et al. An Autoinflammatory Disease with Deficiency of the Interleukin-1-Receptor Antagonist. N Engl J Med 360(23): 2426-2437 (Jun. 4, 2009). doi:10.1056/NEJMoa0807865.

Allured et al., "Structure of exotoxin A of Pseudomonas aeruginosa at 3.0-Angstrom resolution," PNAS USA 83:1320-1324, 1986.

Aman et al. A mutant cholera toxin B subunit that binds GM1-ganglioside but lacks immunomodulatory or toxic activity. PNAS 98(15):8536-8541 (Jul. 17, 2001).

Amorij, et al. Development of stable influenza vaccine powder formulations: challenges and possibilities. Pharm Res. Jun. 2008;25(6):1256-73. Epub Mar. 13, 2008.

Amre et al. Interleukin 10 (IL-10) gene variants and susceptibility for paediatric onset Crohn's disease. Aliment Pharmacol Ther 29(9):1025-31 (May 1, 2009). Epub Feb. 7, 2009.

Anselmo et al. Non-invasive delivery strategies for biologies. Nature Reviews Drug Discovery 18:19-40 (Jan. 2019). Published online Nov. 30, 2018.

Arbit et al. Oral Insulin Delivery in a Physiologic Context: Review. J Diabetes Sci Technol 11(4):825-832 (Jul. 2017) Epub Feb. 2, 2017.

Arend et al. Biological role of interleukin 1 receptor antagonist isoforms. Ann Rheum Dis 59(suppl I):i60-i64 (2000).

Arhewoh et al. An overview of site-specific delivery of orally administered proteins/peptides and modelling considerations. JMBR: A Peer-review Journal of Biomedical Sciences 3(1):7-20 (Jun. 2004).

Asadullah et al. Interleukin-10 Therapy—Review of a New Approach. Pharmacological Reviews 55(2):241-269 (2003). DOI: https://doi.org/10.1124/pr.55.2.4.

Assmus et al. Accurate GI targeting with Eudragit® FS 30D/L 30 D-55 Mixtures. Poster. Evonik Industries (2009). One page.

Awasthi et al. Novel Cholix Toxin Variants, ADP-Ribosylating Toxins in Vibriocholerae Non-O1/Non-O139 Strains, and Their Pathogenicity. Infection and Immunity 81(2):531-541 (Feb. 2013). Published ahead of print Dec. 10, 2012.

Banerjee et al. Ionic liquids for oral insulin delivery. PNAS 115(28):7296-7301 (Jul. 10, 2018). Published online Jun. 25, 2018.

Basset et al. Cholera-Like Enterotoxins and Regulatory T cells. Toxins 2:1774-1795 (Jul. 6, 2010). doi: 10.3390/toxins2071774.

Beddoe, et al. Structure, biological functions and applications of the AB5 toxins. Trends in Biochemical Sciences. 35.7 (2010): 411-418.

Berg et al. Rapid development of colitis in NSAID-treated IL-10-deficient mice. Gastroenterology 123(5):1527-1542 (Nov. 2002).

Bishop-Lilly et al. Genome Sequencing of 15 Clinical Vibrio Isolates, Including 13 Non-O1/Non-O139 Serogroup Strains. Genome Announc 2(5):e00893-14 (Sep. 11, 2014). doi:10.1128/genomeA.00893-14.

Borlinghaus et al. Radiosensitizer Conjugation to the Carcinoma 19-9 Monoclonal Antibody. Cancer Research 47(15):4071-4075 (Aug. 1, 1987).

Bourganis et al. Polyelectrolyte complexes as prospective carriers for the oral delivery of protein therapeutics. European Journal of Pharmaceutics and Biopharmaceutics 111:44-60 (2017). Available online Nov. 12, 2016.

Bowen et al. Spray Drying of Monoclonal Antibodies: Investigating Powder-Based Biologic Drug Substance Bulk Storage. Drying Technology 31:1441-1450 (2013). Published online Sep. 26, 2013.

Bowie et al. Deciphering the message in protein sequences: tolerance to amino acid substitutions. Science 247:1306-1310 (1990).

Bublin et al. Use of a genetic cholera toxin B subunit/allergen fusion molecule as mucosal delivery system with immunosuppressive activity against Th2 immune responses. Vaccine 25(50):8395-8404 (Dec. 5, 2007). DOI: https://doi.org/10.1016/j.vaccine.2007.10.003. Available online Oct. 22, 2007.

Burisch et al. The burden of inflammatory bowel disease in Europe. J Crohns Colitis. May 2013;7(4):322-37.doi: 10.1016/j.crohns.2013.01.010.

Buruiana et al. Recombinant human interleukin 10 for induction of remission in Crohn's disease. Cochrane Database Syst Rev (11):CD005109 (Nov. 10, 2010). 20 pages.

Cavalli et al. Treating rheumatological diseases and co-morbidities with interleukin-1 blocking therapies. Rheumatology 54:2134-2144 (2015). Advance Access publication Jul. 23, 2015. doi: 10.1093/rheumatology/kev269.

Chachare et al. Capsule Coating: Applying an Enteric Coating to Empty Capsule Shells to Accelerate Clinical Trials. Tablets & Capsules 2015. http://www.tabletscapsules.com. 3 pages.

Challener. The complex task of stabilizing proteins is made more challenging due to the limited number of approved excipients. PharmTech.com vol. 2015 Supplement, Issue 3, pp. s35-s39 (Aug. 15, 2015). Retrieved Nov. 15, 2019 from URL: <http://www.pharmtech.com/print/297049?page=full>. 6 pages.

Chang et al. Mechanism of protein stabilization by sugars during freeze-drying and storage: Native structure preservation, specific interaction, and/or immobilization in a glassy matrix? Journal of Pharmaceutical Sciences 94(7):1427-1444 (Jul. 2005).

Chen et al. Cytokine Networks and T-Cell Subsets in Inflammatory Bowel Diseases. Inflammatory Bowel Diseases 22(5):1157-1167 (May 1, 2016).

Chen et al. The Genome of Non-O1 Vibrio cholerae NRT36S Demonstrates the Presence of Pathogenic Mechanisms That Are Distinct from Those of O1 Vibrio cholerae. Infect Immun. May 2007; 75(5): 2645-2647. Published online Feb. 5, 2007. doi: 10.1128/IAI.01317-06.

Chernoff et al. A randomized, controlled trial of IL-10 in humans. Inhibition of inflammatory cytokine production and immune responses. J Immunol 154:5492-5499 (1995).

Choonara et al. A review of advanced oral drug delivery technologies facilitating the protection and absorption of protein and peptide molecules. Biotechnology Advances 32:1269-1282 (2014). Available online Aug. 3, 2014.

(56) References Cited

OTHER PUBLICATIONS

Chung et al. Oral Interleukin-10 Alleviates Polyposis via Neutralization of Pathogenic T-Regulatory Cells. Cancer Research 74(19):5377-5385 (2014). Published online Sep. 16, 2014.
Cole et al. Enteric coated HPMC capsules designed to achieve intestinal targeting. Int J Pharm. Jan. 1, 2002;231(1):83-95.doi: 10.1016/s0378-5173(01)00871-7.
Collnot et al. Nano- and microparticulate drug carriers for targeting of the inflamed intestinal mucosa. Journal of Controlled Release 161(2):235-246 (2012). Available online Jan. 25, 2012.
Colombel et al. Interleukin 10 (Tenovil) in the prevention of postoperative recurrence of Crohn's disease. Gut 49:42-46 (2001).
Co-pending U.S. Appl. No. 16/779,350, inventors Liu; Keyi et al., filed Jan. 31, 2020.
Co-pending U.S. Appl. No. 16/884,456, inventors Mrsny; Randall J. et al., filed May 27, 2020.
Co-pending U.S. Appl. No. 16/997,781, inventors Mrsny; Randall J. et al., filed Aug. 19, 2020.
Co-pending U.S. Appl. No. 17/004,686, inventors Mrsny; Randall J. et al., filed Aug. 27, 2020.
Co-pending U.S. Appl. No. 17/015,011, inventors Liu; Keyi et al., filed Sep. 8, 2020.
Co-pending U.S. Appl. No. 17/129,376, inventors Hunter; Thomas Carl et al., filed Dec. 21, 2020.
Co-pending U.S. Appl. No. 17/169,396, inventors Mrsny; Randall J. et al., filed on Feb. 5, 2021.
Coria et al. Oral co-administration of a bacterial protease inhibitor in the vaccine formulation increases antigen delivery at the intestinal epithelial barrier. Journal of Controlled Release 293:158-171 (2019). Available online Nov. 27, 2018.
Cortesi et al. Eudragit® Microparticles for the Release of Budesonide: A Comparative Study. Indian J Pharm Sci 74(5):415-421 (Sep.-Oct. 2012).
Date et al. Nanoparticles for oral delivery: Design, evaluation and state-of-the-art. Journal of Controlled Release 240:504-526 (Oct. 28, 2016).
Dayer et al. A Brief History of IL-1 and IL-1 Ra in Rheumatology. Front Pharmacol. 2017; 8: 293. Published online May 23, 2017. doi: 10.3389/fphar.2017.00293. 8 pages.
Delie et al. Polymeric Particulates to Improve Oral Bioavailability of Peptide Drugs. Molecules 10(1):65-80 (Jan. 31, 2005).
Deng, et al. Molecular mechanisms of the cytotoxicity of ADP-ribosylating toxins. Annual Review of Microbiology 62 (2008): 271-288.
Deyoung. Development of pancreatic enzyme microsphere technology and US findings with Pancrease in the treatment of chronic pancreatitis. Int J Pancreatol 5 Suppl:31-36 (1989).
Dibiase, et al. Oral delivery of microencapsulated proteins. Pharm Biotechnol. 1997;10:255-88.
Dinarello et al. Overview of the IL-1 family in innate inflammation and acquired immunity. Immunol Rev. Jan. 2018; 281(1): 8-27. doi: 10.1111/imr.12621.
Dionne et al. Colonic explant production of IL-1 and its receptor antagonist is imbalanced in inflammatory bowel disease (IBD). Clin Exp Immunol 112(3):435-442 (1998).
Dohil et al. Enteric-coated cysteamine for the treatment of paediatric non-alcoholic fatty liver disease. Alimentary Pharmacology and Therapeutics 33(9):1036-1044 (May 2011). Published online Mar. 13, 2011.
Dumoutier et al. Cloning and Characterization of IL-10-Related T Cell-Derived Inducible Factor (IL-TIF), a Novel Cytokine Structurally Related to IL-10 and Inducible by IL-9. J Immunol 164:1814-1819 (2000). doi: 10.4049/jimmunol.164.4.1814.
Engelhardt et al. IL-10 in Humans: Lessons from the Gut, IL-10/IL-10 Receptor Deficiencies, and IL-10 Polymorphisms. Curr Top Microbiol Immunol 380:1-18 (2014).
Eudragit® brochure. Evonik Industries (Oct. 7, 2015). 16 pages.
Fedorak et al. Human recombinant interleukin-10 is safe and well tolerated but does not induce remission in steroid dependent Crohn's disease. Gastroenterology vol. 120, Issue5, Supplement 1, p. A127 (Apr. 2001).
Fedorak et al. Recombinant Human Interleukin 10 in the Treatment of Patients With Mild to Moderately Active Crohn's Disease. Gastroenterology 119:1473-1482 (2000).
Feuerstein et al. Crohn Disease: Epidemiology, Diagnosis, and Management. Mayo Clinic Proceedings 92(7):1088-1103 (Jul. 2017).
Fiorentino et al. IL-10 acts on the antigen-presenting cell to inhibit cytokine production by Th1 cells. J Immunol 146(10):3444-3451 (May 15, 1991).
Fitzgerald, et al. Pseudomonas exotoxin-mediated selection yields cells with altered expression of low-density lipoprotein receptor-related protein. Journ of Cell Biology, 129.6 (1995): 1533-1541.
Flood et al. Development of a Freeze-Dried, Heat-Stable Influenza Subunit Vaccine Formulation. PLoS One 11(11):e0164692 (2016). Published online Nov. 16, 2016. 18 pages.
Franke et al. Sequence variants in IL10, ARPC2 and multiple other loci contribute to ulcerative colitis susceptibility. Nature Genetics 40(11):1319-1323 (Nov. 2008). Published online Oct. 5, 2008.
Friedrich et al. Immunomodulation by Interleukin-10 Therapy Decreases the Incidence of Relapse and Prolongs the Relapse-free Interval in Psoriasis. Journal of Investigative Dermatology 118(4):672-677 (2002).
Frolkis et al. Risk of Surgery for Inflammatory Bowel Diseases Has Decreased Over Time: A Systematic Review and Meta-analysis of Population-Based Studies. Gastroenterology 145(5):996-1006 (2013).
Fujiwara et al. Extraction and purification of human interleukin-10 from transgenic rice seeds. Protein Expression and Purification 72(1):125-130 (2010). Available online Feb. 14, 2010.
Gasche et al. IL-10 Secretion and Sensitivity in Normal Human Intestine and Inflammatory Bowel Disease. Journal of Clinical Immunology 20(5):362-370 (2000).
GenBank Accession No. AAW80252. Version No. AAW80252.1 hypothetical exotoxin A [Vibrio cholerae]. Record created Feb. 9, 2005. 2 pages. Retrieved Nov. 11, 2019 at URL: https://www.ncbi.nlm.nih.gov/protein/58615288?report=ipg.
GenBank Accession No. AKB06426. Version No. AKB06426.1. exotoxin A catalytic family protein [Vibrio cholerae]. Record created Apr. 6, 2015. 2 pages. Retrieved Aug. 30, 2019 at URL: https://www.ncbi.nlm.nih.gov/protein/AKB06426.
GenBank Accession No. ALH24940. Version No. ALH24940.1. cholix toxin [Vibrio cholerae], Record created Oct. 11, 2015. 2 pages. Retrieved Sep. 6, 2019 at URL: https://www.ncbi.nlm.nih.gov/protein/ALH24940.1.
GenBank Accession No. ALI16365. Version No. ALI16365.1. truncated cholix toxin [Vibrio cholerae]. Record created Oct. 12, 2015. 2 pages. Retrieved Sep. 9, 2019 at URL: https://www.ncbi.nlm.nih.gov/protein/ALI16365.1.
GenBank Accession No. ALI16366. Version No. ALI16366.1. truncated cholix toxin [Vibrio cholerae]. Record created Oct. 12, 2015. 2 pages. Retrieved Sep. 9, 2019 at URL: https://www.ncbi.nlm.nih.gov/protein/ALI16366.1.
GenBank Accession No. ALI87044. Version No. ALI87044.1. cholix toxin [Vibrio cholerae], Record created Oct. 14, 2015. 2 pages. Retrieved Aug. 30, 2019 at URL: https://www.ncbi.nlm.nih.gov/protein/ALI87044.1.
GenBank Accession No. ALJ02941. Version No. ALJ02941.1. cholix toxin [Vibrio cholerae], Record created Oct. 18, 2015. 2 pages. Retrieved Sep. 6, 2019 at URL: https://www.ncbi.nlm.nih.gov/protein/ALJ02941.1.
GenBank Accession No. AUT32289. Version No. AUT32289.1. cholix toxin [Vibrio cholerae], Record created Jan. 31, 2018. 2 pages. Retrieved Sep. 6, 2019 at URL: https://www.ncbi.nlm.nih.gov/protein/AUT32289.1.
GenBank Accession No. AUT32291. Version No. AUT32291.1. cholix toxin [Vibrio cholerae]. Record created Jan. 31, 2018. 2 pages. Retrieved Sep. 6, 2019 at URL: https://www.ncbi.nlm.nih.gov/protein/AUT32291.1.

(56) References Cited

OTHER PUBLICATIONS

GenBank Accession No. AUT32293. Version No. AUT32293.1. cholix toxin [Vibrio cholerae], Record created Jan. 31, 2018. 2 pages. Retrieved Sep. 6, 2019 at URL: https://www.ncbi.nlm.nih.gov/protein/AUT32293.1.
GenBank Accession No. AUT32294. Version No. AUT32294.1. cholix toxin [Vibrio cholerae], Record created Jan. 31, 2018. 2 pages. Retrieved Sep. 6, 2019 at URL: https://www.ncbi.nlm.nih.gov/protein/AUT32294.1.
GenBank Accession No. BAM72568. Version No. BAM72568.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72568.1.
GenBank Accession No. BAM72569. Version No. BAM72569.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72569.1.
GenBank Accession No. BAM72570. Version No. BAM72570.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72570.1.
GenBank Accession No. BAM72571. Version No. BAM72571.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72571.1.
GenBank Accession No. BAM72573. Version No. BAM72573.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72573.1.
GenBank Accession No. BAM72574. Version No. BAM72574.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72574.1.
GenBank Accession No. BAM72575. Version No. BAM72575.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72575.1.
GenBank Accession No. BAM72576. Version No. BAM72576.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72576.1.
GenBank Accession No. BAM72582. Version No. BAM72582.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72582.1.
GenBank Accession No. BAM72585. Version No. BAM72585.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72585.1.
GenBank Accession No. BAM72587. Version No. BAM72587.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72587.1.
GenBank Accession No. BAM72590. Version No. BAM72590.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72590.1.
GenBank Accession No. BAM72593. Version No. BAM72593.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72593.1.
GenBank Accession No. BAM72594. Version No. BAM72594.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72594.1.
GenBank Accession No. BAM72595. Version No. BAM72595.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72595.1.
GenBank Accession No. BAM72596. Version No. BAM72596.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72596.1.
GenBank Accession No. BAM72610. Version No. BAM72610.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72610.1.
GenBank Accession No. BAM72611. Version No. BAM72611.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72611.1.
GenBank Accession No. EFH75651. Version No. EFH75651.1. conserved hypothetical protein [Vibrio cholerae RC385], Record created Jun. 4, 2010. 2 pages. Retrieved Sep. 6, 2019 at URL: https://www.ncbi.nlm.nih.gov/protein/EFH75651.1.
GenBank Accession No. KFD89501. Version No. KFD89501.1. exotoxin A binding family protein [Vibrio cholerae]. Record created Jul. 31, 2014. pages. Retrieved Sep. 6, 2019 at URL: https://www.ncbi.nlm.nih.gov/protein/KFD89501.1.
GenBank Accession No. KFD96741. Version No. KFD96741.1. exotoxin A binding family protein [Vibrio cholerae]. Record created Jul. 31, 2014. 2 pages. Retrieved Sep. 9, 2019 at URL: https://www.ncbi.nlm.nih.gov/protein/KFD96741.1.
GenBank Accession No. KFE28160. Version No. KFE28160.1. exotoxin A binding family protein [Vibrio cholerae]. Record created Jul. 31, 2014. 2 pages. Retrieved Sep. 6, 2019 at URL: https://www.ncbi.nlm.nih.gov/protein/KFE28160.1.
GenBank Accession No. KNH55243. Version No. KNH55243.1. hypothetical protein A59_2898 [Vibrio cholerae 623-39], Record created Aug. 5, 2015. 2 pages. Retrieved Sep. 6, 2019 at URL: https://www.ncbi.nlm.nih.gov/protein/KNH55243.1.
GenBank Accession No. P01241. Somatotropin. Record created Jul. 21, 1986. 12 pages. Retrieved Aug. 29, 2019 at URL: https://www.ncbi.nlm.nih.gov/protein/P01241.
GenBank Accession No. Q5EK40. Version No. Q5EK40.1. Cholix toxin. Record created Feb. 9, 2005. 9 pages. Retrieved Aug. 30, 2019 at URL: https://www.ncbi.nlm.nih.gov/protein/Q5EK40.1.
GenBank Accession No. SYZ81493. Version No. SYZ81493.1. Cholixtoxin precursor [Vibrio cholerae]. Record created Sep. 6, 2018. 1 page. Retrieved Sep. 9, 2019 at URL: https://www.ncbi.nlm.nih.gov/protein/SYZ81493.1.
GenBank Accession No. WP_000941100. Version No. WP_000941100.1. Multispecies: cholix toxin [Vibrio], Record created Feb. 5, 2013. 1 page. Retrieved Sep. 9, 2019 at URL: https://www.ncbi.nlm.nih.gov/protein/WP_000941100.1.
GenBank Accession No. WP_002044040. Version No. WP_002044040.1. cholixtoxin [Vibrio cholerae]. Record created May 4, 2013. 1 page. Retrieved Sep. 9, 2019 at URL: https://www.ncbi.nlm.nih.gov/protein/WP_002044040.1.
GenBank Accession No. WP_032467916. Version No. WP_032467916.1. cholixtoxin [Vibrio cholerae]. Record created Oct. 4, 2014. 1 page. Retrieved Sep. 9, 2019 at URL: https://www.ncbi.nlm.nih.gov/protein/WP_032467916.1.
GenBank Accession No. WP_032482668. Version No. WP_032482668.1. cholix toxin [Vibrio cholerae]. Record created Oct. 4, 2014. 1 page. Retrieved Sep. 9, 2019 at URL: https://www.ncbi.nlm.nih.gov/protein/WP_032482668.1.
GenBank Accession No. WP_033932701. Version No. WP_033932701.1. cholix toxin [Vibrio cholerae]. Record created Dec. 5, 2014. 1 page. Retrieved Sep. 9, 2019 at URL: https://www.ncbi.nlm.nih.gov/protein/WP_033932701.1.
GenBank Accession No. WP_042988437. Version No. WP_042988437.1. cholix toxin [Vibrio cholerae]. Record created Feb. 17, 2015. 1 page. Retrieved Sep. 9, 2019 at URL: https://www.ncbi.nlm.nih.gov/protein/WP_042988437.1.
GenBank Accession No. WP_057552180. Version No. WP_057552180.1. cholix toxin [Vibrio cholerae]. Record created Nov. 10, 2015. 1 page. Retrieved Sep. 9, 2019 at URL: https://www.ncbi.nlm.nih.gov/protein/WP_057552180.1.

(56) References Cited

OTHER PUBLICATIONS

GenBank Accession No. WP_057557199. Version No. WP_057557199.1. cholix toxin [Vibrio cholerae]. Record created Nov. 10, 2015. 1 page. Retrieved Sep. 9, 2019 at URL: https://www.ncbi.nlm.nih.gov/protein/WP_057557199.1.

GenBank Accession No. WP_069648100. Version No. WP_069648100.1. cholix toxin [Vibrio cholerae]. Record created Sep. 20, 2016. 1 page. Retrieved Sep. 9, 2019 at URL: https://www.ncbi.nlm.nih.gov/protein/WP_069648100.1.

GenBank Accession No. WP_071178365. Version No. WP_071178365.1. cholix toxin [Vibrio cholerae]. Record created Nov. 2, 2016. 1 page. Retrieved Sep. 9, 2019 at URL: https://www.ncbi.nlm.nih.gov/protein/WP_071178365.1.

GenBank Accession No. WP_071186455. Version No. WP_071186455.1. cholix toxin [Vibrio cholerae]. Record created Nov. 2, 2016. 1 page. Retrieved Sep. 9, 2019 at URL: https://www.ncbi.nlm.nih.gov/protein/WP_071186455.1.

GenBank Accession No. WP_076008260. Version No. WP_076008260.1. cholix toxin [Vibrio cholerae]. Record created Jan. 19, 2017. 1 page. Retrieved Sep. 9, 2019 at URL: https://www.ncbi.nlm.nih.gov/protein/WP_076008260.1.

GenBank Accession No. WP_076025263. Version No. WP_076025263.1. cholix toxin [Vibrio cholerae]. Record created Jan. 19, 2017. 1 page. Retrieved Sep. 9, 2019 at URL: https://www.ncbi.nlm.nih.gov/protein/WP_076025263.1.

GenBank Accession No. WP_084980904. Version No. WP_084980904.1. cholix toxin [Vibrio cholerae]. Record created Apr. 21, 2017. 1 page. Retrieved Sep. 9, 2019 at URL: https://www.ncbi.nlm.nih.gov/protein/WP_084980904.1.

GenBank Accession No. WP_088131881. Version No. WP_088131881.1. cholix toxin [Vibrio cholerae]. Record created Jun. 19, 2017. 1 page. Retrieved Sep. 6, 2019 at URL: https://www.ncbi.nlm.nih.gov/protein/WP_088131881.1.

GenBank Accession No. WP_095461883. Version No. WP_095461883.1. cholix toxin [Vibrio cholerae]. Record created Sep. 2, 2017. 1 page. Retrieved Sep. 9, 2019 at URL: https://www.ncbi.nlm.nih.gov/protein/WP_095461883.1.

GenBank Accession No. WP_095463544. Version No. WP_095463544.1. cholix toxin [Vibrio cholerae]. Record created Sep. 2, 2017. 1 page. Retrieved Sep. 9, 2019 at URL: https://www.ncbi.nlm.nih.gov/protein/WP_095463544.1.

GenBank Accession No. WP_095466115. Version No. WP_095466115.1. cholix toxin [Vibrio cholerae]. Record created Sep. 2, 2017. 1 page. Retrieved Sep. 6, 2019 at URL: https://www.ncbi.nlm.nih.gov/protein/WP_095466115.1.

GenBank Accession No. WP_095473667. Version No. WP_095473667.1. cholix toxin [Vibrio cholerae]. Record created Sep. 2, 2017. 1 page. Retrieved Sep. 9, 2019 at URL: https://www.ncbi.nlm.nih.gov/protein/WP_095473667.1.

GenBank Accession No. WP_095477173. Version No. WP_095477173.1. cholix toxin [Vibrio cholerae]. Record created Sep. 2, 2017. 1 page. Retrieved Sep. 9, 2019 at URL: https://www.ncbi.nlm.nih.gov/protein/WP_095477173.1.

GenBank Accession No. WP_095490358. Version No. WP_095490358.1. cholix toxin [Vibrio cholerae]. Record created Sep. 2, 2017. 1 page. Retrieved Sep. 9, 2019 at URL: https://www.ncbi.nlm.nih.gov/protein/WP_095490358.1.

GenBank Accession No. WP_113605545. Version No. WP_113605545.1. cholix toxin [*Vibrio* sp. 2017V-1105], Record created Jul. 15, 2018. 1 page. Retrieved Sep. 9, 2019 at URL: https://www.ncbi.nlm.nih.gov/protein/WP_113605545.1.

GenBank Accession No. WP_113620122. Version No. WP_113620122.1. cholix toxin [*Vibrio* sp. 2014V-1107], Record created Jul. 15, 2018. 1 page. Retrieved Sep. 9, 2019 at URL: https://www.ncbi.nlm.nih.gov/protein/WP_113620122.1.

GenBank Accession No. WP_113628761. Version No. WP_113628761.1. cholix toxin [Vibrio cholerae]. Record created Jul. 15, 2018. 1 page. Retrieved Sep. 6, 2019 at URL: https://www.ncbi.nlm.nih.gov/protein/WP_113628761.1.

GenBank Accession No. WP_114707943. Version No. WP_114707943.1. cholix toxin [Vibrio cholerae]. Record created Aug. 2, 2018. 1 page. Retrieved Sep. 9, 2019 at URL: https://www.ncbi.nlm.nih.gov/protein/WP_114707943.1.

GenBank Accession No. WP_114708586. Version No. WP_114708586.1. cholix toxin [Vibrio cholerae]. Record created Aug. 2, 2018. 1 page. Retrieved Sep. 6, 2019 at URL: https://www.ncbi.nlm.nih.gov/protein/WP_114708586.1.

GenBank Accession No. WP_114711324. Version No. WP_114711324.1. cholix toxin [Vibrio cholerae]. Record created Aug. 2, 2018. 1 page. Retrieved Sep. 9, 2019 at URL: https://www.ncbi.nlm.nih.gov/protein/WP_114711324.1.

GenBank Accession No. WP_1 14718037. Version No. WP_114718037.1. cholix toxin [Vibrio cholerae]. Record created Aug. 2, 2018. 1 page. Retrieved Sep. 6, 2019 at URL: https://www.ncbi.nlm.nih.gov/protein/WP_114718037.1.

GenBank Accession No. WP_114728533. Version No. WP_114728533.1. cholix toxin [Vibrio cholerae]. Record created Aug. 2, 2018. 2 pages. Retrieved Sep. 6, 2019 at URL: https://www.ncbi.nlm.nih.gov/protein/WP_114728533.1.

GenBank Accession No. WP_114735885. Version No. WP_114735885.1. cholix toxin [Vibrio cholerae]. Record created Aug. 2, 2018. 1 page. Retrieved Sep. 6, 2019 at URL: https://www.ncbi.nlm.nih.gov/protein/WP_114735885.1.

GenBank Accession No. WP_114741531. Version No. WP_114741531.1. cholixtoxin [Vibrio cholerae]. Record created Aug. 2, 2018. 1 page. Retrieved Sep. 6, 2019 at URL: https://www.ncbi.nlm.nih.gov/protein/WP_114741531.1.

GenBank Accession No. WP_114743333. Version No. WP_114743333.1. cholixtoxin [Vibrio cholerae]. Record created Aug. 2, 2018. 1 page. Retrieved Sep. 9, 2019 at URL: https://www.ncbi.nlm.nih.gov/protein/WP_114743333.1.

GenBank Accession No. WP_114774300. Version No. WP_114774300.1. cholixtoxin [Vibrio cholerae]. Record created Aug. 2, 2018. 1 page. Retrieved Sep. 6, 2019 at URL: https://www.ncbi.nlm.nih.gov/protein/WP_114774300.1.

GenBank Accession No. WP_114776277. Version No. WP_114776277.1. cholixtoxin [Vibrio cholerae]. Record created Aug. 2, 2018. 1 page. Retrieved Sep. 6, 2019 at URL: https://www.ncbi.nlm.nih.gov/protein/WP_114776277.1.

GenBank Accession No. WP_114788528. Version No. WP_114788528.1. cholixtoxin, partial [Vibrio cholerae]. Record created Aug. 2, 2018. 1 page. Retrieved Sep. 9, 2019 at URL: https://www.ncbi.nlm.nih.gov/protein/WP_114788528.1.

GenBank Accession No. WP_1 14794357. Version No. WP_1 14794357.1. cholix toxin [Vibrio cholerae]. Record created Aug. 2, 2018. 1 page. Retrieved Sep. 6, 2019 at URL: https://www.ncbi.nlm.nih.gov/protein/WP_114794357.1.

GenBank Accession No. WP_114808068. Version No. WP_114808068.1. cholix toxin [Vibrio cholerae]. Record created Aug. 2, 2018. 1 page. Retrieved Sep. 9, 2019 at URL: https://www.ncbi.nlm.nih.gov/protein/WP_114808068.1.

GenBank Accession No. WP_114967888. Version No. WP_114967888.1. cholix toxin [Vibrio cholerae]. Record created Aug. 3, 2018. 1 page. Retrieved Sep. 9, 2019 at URL: https://www.ncbi.nlm.nih.gov/protein/WP_114967888.1.

GenBank Accession No. WP_114974465. Version No. WP_114974465.1. cholix toxin [Vibrio cholerae]. Record created Aug. 3, 2018. 1 page. Retrieved Sep. 9, 2019 at URL: https://www.ncbi.nlm.nih.gov/protein/WP_114974465.1.

GenBank Accession No. WP_119788544. Version No. WP_119788544.1. cholix toxin [Vibrio cholerae]. Record created Sep. 26, 2018. 1 page. Retrieved Sep. 9, 2019 at URL: https://www.ncbi.nlm.nih.gov/protein/WP_119788544.1.

GenBank Accession No. WP_123013236. Version No. WP_123013236.1. cholix toxin [Vibrio cholerae]. Record created Nov. 10, 2018. 1 page. Retrieved Sep. 9, 2019 at URL: https://www.ncbi.nlm.nih.gov/protein/WP_123013236.1.

GenBank Accession No. WP_123162729. Version No. WP_123162729.1. cholix toxin [Vibrio cholerae]. Record created Nov. 14, 2018. 1 page. Retrieved Sep. 9, 2019 at URL: https://www.ncbi.nlm.nih.gov/protein/WP_123162729.1.

(56) References Cited

OTHER PUBLICATIONS

Ghasemi et al. mPEG-PLA and PLA-PEG-PLA nanoparticles as new carriers for delivery of recombinant human Growth Hormone (rhGH). Scientific Reports vol. 8, Article No. 9854 (Jun. 29, 2018). Author correction published Sep. 3, 2019. 13 pages.
Glocker et al. IL-10 and IL-10 receptor defects in humans. Ann N Y Acad Sci 1246:102-107 (2011).
Gu et al. Oral IL-10 suppresses colon carcinogenesis via elimination of pathogenicCD4+ T-cells and induction of antitumor CD8+ T-cell activity. Oncoimmunology 6(6):e1319027 (2017). Accepted author version posted online Apr. 20, 2017. Published online May 30, 2017. 9 pages.
Han et al. Active Site Mutations of Pseudomonas aeruginosa Exotoxin A: Analysis of the HIS440 Residue. Journal of Biological Chemistry 270(2):679-684 (Jan. 13, 1995).
Henriksen, M. et al., C-reactive protein: a predictive factor of inflammation in inflammatory bowel disease. Results from a prospective population-based study. Gut 57:1518-1523 (2008).
Hsu, et al. Vaccination against Gonadotropin-releasing Hormone (GnRH). Cancer Res. Jul. 15, 2000; 60:3701-3705.
Huhn et al. Pharmacodynamics of subcutaneous recombinant human interleukin-10 in healthy volunteers. Clin Pharmacol Ther 62:171-180 (1997).
Huhn et al. Pharmacokinetics and immunomodulatory properties of intravenously administered recombinant human interleukin-10 in healthy volunteers. Blood 87(2):699-705 (Jan. 15, 1996).
Huyghebaert et al. In vitro evaluation of coating polymers for enteric coating and human ileal targeting. International Journal of Pharmaceutics 298(1):26-37 (2005). Available online May 13, 2005.
Hwang et al. Structure and function relationship of Pseudomonas exotoxin A. An immunochemical study. The Journal of Biological Chemistry 264(4):2379-2384 (1989).
Hyams et al. Relationship of interleukin-1 receptor antagonist to mucosal inflammation in inflammatory bowel disease. J Pediatr Gastroenterol Nutr. 21(4):419-425 (1995). DOI: 10.1097/00005176-199511000-00008.
Jenkins et al. The effects of interleukin-10 on interleukin-1 receptor antagonist and interleukin-1 beta production in human monocytes and neutrophils. Lymphokine Cytokine Res 13(1):47-54 (1994).
Jinno et al. Mutational analysis of domain I of Pseudomonas exotoxin. Mutations in domain I of Pseudomonas exotoxin which reduce cell binding and animal toxicity. The Journal of Biological Chemistry 263(26):13203-13207 (Sep. 15, 1988).
Johnson et al. Complete Genome Assemblies for Two Single-Chromosome Vibrio cholerae Isolates, Strains 1154-74 (Serogroup O49) and 10432-62 (Serogroup O27). Genome Announc 3(3):e00462-15 (May 14, 2015). 2 pages. doi:10.1128/genomeA.00462-15.
Josephson et al. Crystal Structure of the IL-10/IL-10R1 Complex Reveals a Shared Receptor Binding Site. Immunity 15(1):35-46 (Jul. 2001). DOI: https://doi.org/10.1016/S1074-7613(01)00169-8.
Jovanović et al. Stabilization of Proteins in Dry Powder Formulations Using Supercritical Fluid Technology. Pharmaceutical Research 21:1955-1969 (Nov. 2004).
Jørgensen, et al. Cholix toxin, a novel ADP-ribosylating factor from Vibrio cholerae. Journal of Biological Chemistry 283.16 (Apr. 18, 2008): 10671-10678.
Jung et al. Biodegradable nanoparticles for oral delivery of peptides: is there a role for polymers to affect mucosal uptake? Eur J Pharm Biopharm. Jul. 2000;50(1):147-60.
Karlin, et al. Applications and statistics for multiple high-scoring segments in molecular sequences. PNAS USA 90:5873-5877 (1993).
Karolewicz. A review of polymers as multifunctional excipients in drug dosage form technology. Saudi Pharmaceutical Journal 24(5):525-536 (2016). Available online Mar. 7, 2015.
Khan et al. Recent progress of drug nanoformulations targeting to brain. Journal of Controlled Release 291:37-64 (2018). Available online Oct. 9, 2018.
Killeen, et al. Conformational integrity of a recombinant toxoid of Pseudomonas aeruginosa exotoxin A containing a deletion of glutamic acid-553. Biochimica et Biophysica Acta (BBA)-Molecular Basis of Disease 1138.2 (1992): 162-166.
Kimball et al. Clinical and immunologic assessment of patients with psoriasis in a randomized, double-blind, placebo-controlled trial using recombinant human interleukin 10. Arch Dermatol 138:1341-6 (Oct. 2002).
Klukkert et al. Influence of Tableting on the Conformation and Thermal Stability of Trypsin as a Model Protein. Journal of Pharmaceutical Sciences 104(12):4314-4321 (2015). Published online Oct. 13, 2015.
Knappe et al. Induction of a Novel Cellular Homolog of Interleukin-10, AK155, by Transformation of T Lymphocytes with Herpesvirus Saimiri. J Virol 74(8): 3881-3887 (Apr. 2000).
Kondo et al. Activity of immunotoxins constructed with modified Pseudomonas exotoxin A lacking the cell recognition domain. J Biol Chem 263(19):9470-9475 (Jul. 5, 1988).
Kornbluth et al. Ulcerative Colitis Practice Guidelines in Adults: American College of Gastroenterology, Practice Parameters Committee. American Journal of Gastroenterology 105(3):501-523 (2010). Published online Jan. 12, 2010.
Korz et al. Simple fed-batch technique for high cell density cultivation of *Escherichia coli*. J Biotechnol 39:59-65 (1995).
Kumar et al. Genome Sequence of Non-O1 Vibrio cholerae PS15. Genome Announcements 1(1):e00227-12 (Jan./Feb. 2013). 2 pages.
Kverka et al. Two faces of microbiota in inflammatory and autoimmune diseases: triggers and drugs. APMIS 2013; 121: 403-21.
Lanis et al. Tryptophan Metabolite Activation of the Aryl Hydrocarbon Receptor Regulates IL10 Receptor Expression on Intestinal Epithelia. Mucosal Immunol. Sep. 2017; 10(5): 1133-1144. Published online Jan. 18, 2017. doi: 10.1038/mi.2016.133.
Lans et al. Role of tumor necrosis factor on toxicity and cytokine production after isolated hepatic perfusion. Clin Cancer Res 7(4):784-790 (Apr. 2001).
Laroui et al. Dextran Sodium Sulfate (DSS) Induces Colitis in Mice by Forming Nano-Lipocomplexes with Medium-Chain-Length Fatty Acids in the Colon. PLoS One. 2012; 7(3): e32084. Published online Mar. 9, 2012. doi: 10.1371/journal.pone.0032084. 12 pages.
Larsen et al. Interleukin-1-Receptor Antagonist in Type 2 Diabetes Mellitus. N Engl J Med 356(15):1517-1526 (Apr. 12, 2007).
Laurent. Characterization of the trafficking pathway used by Pseudomonas aeruginosa Exotoxin A and application to oral drug delivery. Ph.D. Thesis. University of Bath. Dec. 2015. Retrieved Dec. 18, 2019 from URL: https://purehost.bath.ac.uk/ws/portalfiles/portal/187920618/Thesis_F.Laurent_Dec2015.pdf. 312 pages.
Leach et al. The Role of IL-10 in Inflammatory Bowel Disease: "Of Mice and Men." Toxicol Pathol 27(1):123-33 (1999).
Lee et al. Impact of Regional Intestinal pH Modulation on Absorption of Peptide Drugs: Oral Absorption Studies of Salmon Calcitonin in Beagle Dogs. Pharmaceutical Research 16(8):1233-1239 (1999).
Li et al. IL-10 and its related cytokines for treatment of inflammatory bowel disease. World J Gastroenterol 10(5):620-625 (2004).
Lin et al. Genetic association and epistatic interaction of the interleukin-10 signaling pathway in pediatric inflammatory bowel disease. World J Gastroenterol. Jul. 21, 2017; 23(27): 4897-4909.
Lin et al. Different Types of Cell Death Induced by Enterotoxins. Toxins 2:2158-2176 (Aug. 11, 2010). doi:10.3390/toxins2082158.
Lueben et al. Mucoadhesive Polymers in Peroral Peptide Drug Delivery. II. Carbomer and Polycarbophil Are Potent Inhibitors of the Intestinal Proteolytic Enzyme Trypsin. Pharmaceutical Research 12(9):1293-1298 (1995).
Lugo et al. The Father, Son and Cholix Toxin: The Third Member of the DT Group Mono-ADP-Ribosyltransferase Toxin Family. Toxins 7(8):2757-2772 (Jul. 24, 2015).
Magro et al. Third European Evidence-based Consensus on Diagnosis and Management of Ulcerative Colitis. Part 1: Definitions, Diagnosis, Extra-intestinal Manifestations, Pregnancy, Cancer Surveillance, Surgery, and Ileo-anal Pouch Disorders. J Crohns Colitis 11(6):649-670 (2017). Advance Access publication Feb. 2, 2017.
Maharaj et al. Simple rapid method for the preparation of enteric-coated microspheres. Journal of Pharmaceutical Sciences 73(1):39-42 (Jan. 1984).

(56) References Cited

OTHER PUBLICATIONS

Mahato et al. Emerging trends in oral delivery of peptide and protein drugs. Crit Rev Ther Drug Carrier Syst. 2003;20(2-3):153-214.
Maqbool et al. Wireless capsule motility: comparison of the SmartPill GI monitoring system with scintigraphy for measuring whole gut transit. Dig Dis Sci. 54:2167-2174 (2009). Published online Aug. 5, 2009.
Marlow et al. Why interleukin-10 supplementation does not work in Crohn's disease patients. World J Gastroenterol 19(25):3931-3941 (Jul. 7, 2013).
Mattoo et al. Interactions of bacterial effector proteins with host proteins. Curr Opin Immunol. Aug. 2007;19(4):392-401.
Mekalanos et al. Cholera toxin genes: nucleotide sequence, deletion analysis and vaccine development. Nature 306:551-557 (1983).
Menassa et al. Therapeutic effectiveness of orally administered transgenic low-alkaloid tobacco expressing human interleukin-10 in a mouse model of colitis. Plant Biotechnol J, vol. 5, pp. 50-59 (2007).doi: 10.1111/j.1467-7652.2006.00214.x.
Mensink et al. How sugars protect proteins in the solid state and during drying (review): Mechanisms of stabilization in relation to stress conditions. European Journal of Pharmaceutics and Biopharmaceutics 114:288-295 (May 2017). Available online Feb. 9, 2017.
Merritt et al. Crystal structure of cholera toxin B-pentamer bound to receptor GM1 pentasaccharide. Protein Science 3:166-175 (1994).
Müller et al. Modulating the Th1/Th2 balance in inflammatory arthritis. Springer Semin Immunopathol 20(1-2):181-196 (1998).
Mocellin et al. The multifaceted relationship between IL-10 and adaptive immunity: putting together the pieces of a puzzle. Cytokine Growth Factor Rev 15:61-76 (2004).
Molly et al. Development of a 5-step multi-chamber reactor as a simulation of the human intestinal microbial ecosystem. Appl Microbiol Biotechnol39:254-258 (1993).
Montfrans et al. Prevention of colitis by interleukin-10-transduced T lymphocytesin the SCID mice transfer model. Gastroenterology 123:1865-1876 (2002).
Moore et al. Interleukin-10 and the interleukin-10 receptor. Annu Rev Immunol 19:683-765 (2001). DOI: 10.1146/annurev.immunol.19.1.683.
Moroz, et al. Oral delivery of macromolecular drugs: Where we are after almost 100 years of attempts. Adv Drug Deliv Rev. Jun. 1, 2016;101:108-121.
Mosmann, Tim R. Properties and Functions of Interleukin-10. Advances in Immunology, vol. 56, pp. 1-26 (1994).
Mowat et al. Guidelines for the management of inflammatory bowel disease in adults. Gut 60(5):571-607 (2011). Published online Apr. 4, 2011.
Mowat et al. Regional specialization within the intestinal immune system. Nature Reviews Immunology 14:667-685 (Oct. 2014).
Mrsny. A Carrier-Mediated Approach for the Oral Delivery of Protein Therapeutics. (Presentation.) (Aug. 28, 2019.) 24 pages.
Mrsny. Biotech Start-up—A Practical Guide. Bath, United Kingdom (Presentation.) (Nov. 19, 2018.) 18 pages.
Mrsny. Breaking Through the Biological Barriers that Limit Protein Drug Delivery. Bangor University, United Kingdom (Presentation.) (Aug. 6, 2015.) 26 pages.
Mrsny. Breaking Through the Biological Barriers that Limit Protein Drug Delivery. (Presentation.) Controlled Release Society, Florence, Italy (Nov. 8, 2014.) 43 pages.
Mrsny. Breaking Through the Biological Barriers that Limit Protein Drug Delivery. (Presentation.) Tours, France (Jul. 2, 2015.) 25 pages.
Mrsny. Employing endogenous pathways for the oral delivery of biopharmaceuticals. (Presentation.) Reading, United Kingdom (Jul. 18, 2018.) 35 pages.
Mrsny, et al. Bacterial toxins as tools for mucosal vaccination. Drug Discovery Today. 2002; 4:247-258.
Mrsny et al. Mucosal administration of a chimera composed of Pseudomonas exotoxin and the gp120 V3 loop sequence of HIV-1 induces both salivary and serum antibody responses. Vaccine 17(11-12):1425-1433 (Mar. 17, 1999).
Mrsny. Harnessing Mucosal Immunology for Health. Bath, United Kingdom (Presentation.) (Sep. 25, 2018.) 29 pages.
Mrsny. Harnessing Mucosal Immunology for Health. Ma'alot-Tarshiha, Israel(Presentation.) (Oct. 7, 2018.) 28 pages.
Mrsny. It Starts With Asking Big Questions. Valencia, Spain (Presentation.) (Jul. 21, 2019.) 20 pages.
Mrsny, Lessons from nature: "Pathogen-Mimetic" systems for Mucosal Nano-medicines, Advanced Drug Delivery Reviews, vol. 61 :172-192 (online Dec. 24, 2008).
Mrsny. Molecular mechanisms of transcytosis pathways: Drug delivery thru epithelial and endothelial barriers. (Presentation.) (Dec. 3, 2010). 42 pages.
Mrsny. Molecular mechanisms of transcytosis pathways: Drug delivery thru epithelial and endothelial barriers. (Presentation.) Emory University, Atlanta, GA, United States. (Sep. 24, 2010). 51 pages.
Mrsny. Molecular mechanisms of transcytosis pathways: Drug delivery thru epithelial and endothelial barriers. (Presentation.) Nanomedicine and Drug Delivery Symposium (NanoDDS), University of Nebraska Omaha, Omaha, NE, United States. (Oct. 3, 2010.) 42 pages.
Mrsny. My Secondment(Gap Years?) at AMT. University of Bath, United Kingdom(Presentation.) (Oct. 6, 2017.) 20 pages.
Mrsny. Overcoming Barriers to Oral Protein Delivery. Boston, MA, United States (Presentation.) (Jul. 23, 2018.) 35 pages.
Mrsny. Overcoming Biological Barriers that Limit Peptide and Protein Drug Delivery. Berlin, Germany (Presentation.) (May 23, 2016.) 26 pages.
Mrsny. Overcoming Biological Barriers that Limit Peptide and Protein Drug Delivery. Denver, CO, United States (Presentation.) (Nov. 17, 2016.) 15 pages.
Mrsny. Overcoming Biological Barriers that Limit Peptide and Protein Drug Delivery. (Presentation.) (Jun. 14, 2016.) 36 pages.
Mrsny. Overcoming Biological Barriers that Limit Peptide and Protein Drug Delivery. University of California San Francisco, CA, United States (Presentation.) (Mar. 24, 2016.) 36 pages.
Mrsny. Paracellular and Transcellular Strategies to Enhance Oral Protein Delivery. (Presentation.) San Francisco, CA, United States (Mar. 15, 2013.) 41 pages.
Mrsny. Paracellular and Transcellular Strategies to Enhance Oral Protein Delivery. (Presentation.) Seoul, South Korea (Mar. 15, 2012.) 54 pages.
Mrsny. Paracellular and Transcellular Strategies to Enhance Oral Protein Delivery. (Presentation.) University of California, Santa Barbara, CA, United States. (Feb. 26, 2013.) 54 pages.
Mrsny. Permeation of barriers for GI and pulmonary drug delivery. (Presentation.) Gordon Research Conference, New Hampshire, United States. (Aug. 13, 2012.) 46 pages.
Mrsny. Prospects for Oral Delivery of Peptide and Protein Therapeutics. San Francisco, CA, United States (Presentation.) (May 21, 2018.) 29 pages.
Mrsny. Prospects for Oral Delivery of Peptide and Protein Therapeutics. University of Nottingham, United Kingdom(Presentation.) (Jun. 20, 2018.) 62 pages.
Mrsny. Strategies to Enhance the Oral Delivery of Therapeutic Proteins and Peptides. (Presentation.) Berlin, Germany. (Sep. 28, 2011.) 42 pages.
Mrsny. Strategies to Enhance the Oral Delivery of Therapeutic Proteins and Peptides. (Presentation.) Dunedin, New Zealand (Feb. 15, 2012). 42 pages.
Mrsny. Strategies to Enhance the Oral Delivery of Therapeutic Proteins and Peptides. (Presentation.) Nottingham, United Kingdom. (Sep. 2, 2011.) 42 pages.
Mrsny. Strategies to Enhance the Oral Delivery of Therapeutic Proteins and Peptides. (Presentation.) San Francisco, CA, United States. (Jun. 20, 2011.) 42 pages.
Mrsny. Strategies to Enhance the Oral Delivery of Therapeutic Proteins and Peptides. (Presentation.) The University of Sheffield, Sheffield, United Kingdom. (Jan. 16, 2012.) 42 pages.

(56) References Cited

OTHER PUBLICATIONS

Mrsny. TJ Regulation using Cell-Penetrating Peptides. (Presentation.) University of Copenhagen, Denmark (May 12, 2015.) 62 pages.
Mrsny. Understanding & Developing the Science Behind Oral Protein and Peptide Delivery. (Presentation.) Nottingham, United Kingdom (Jan. 22, 2014.) 48 pages.
Mrsny. Understanding & Developing the Science Behind Oral Protein Delivery: An Academic Case Study. (Presentation.) Berlin, Germany (Feb. 20, 2013.) 39 pages.
Mrsny. Understanding & Developing the Science Behind Oral Protein Delivery. (Presentation.) University of North Carolina at Chapel Hill, Chapel Hill, North Carolina, United States. (May 28, 2014.) 37 pages.
Mrsny. Understanding & Developing the Science Behind Oral Protein Delivery. (Presentation.) University of Westminster, London, United Kingdom. (Mar. 15, 2013). 40 pages.
Mrsny. Understanding & Developing the Science Behind Oral Protein Delivery. (Presentation.) Academy of Pharmaceutical Sciences, Edinburgh, United Kingdom.(Sep. 3, 2013). 40 pages.
Mrsny. Understanding & Developing the Science Behind Oral Protein Delivery. (Presentation.) University College Dublin, Dublin, Ireland (May 22, 2013). 44 pages.
Mrsny. Understanding & Developing the Science Behind Oral Protein Delivery. (Presentation.) University of East Anglia, Norwich, United Kingdom (Jun. 27, 2013). 43 pages.
Mrsny. Understanding Exotoxin Transcytosis for the Application of Oral Protein Delivery. Dresden, Germany (Presentation.) (Nov. 12, 2015.) 26 pages.
Nadkarni. Multi Particulate Drug Delivery Systems (MDDS) for Oral Modified Release (MR). Presentation. 5th Annual Modified & Controlled Drug Release Summit, Philadelphia, PA. Nov. 28-29, 2018. 34 pages.
Neumann et al. Functions and regulation of T cell-derived interleukin-10. Semin Immunol 44:101344 (2019). doi: 10.1016/j.smim.2019.101344. Epub Nov. 12, 2019.
Neurath. Current and emerging therapeutic targets for IBD. Nature Reviews Gastroenterology & Hepatology 14:269-278 (May 2017).
Neurath. Cytokines in inflammatory bowel disease. Nature Reviews Immunology 14:329-342 (May 2014).
Nguyen et al. STAT3-Activating Cytokines: A Therapeutic. Journal of Interferon & Cytokine Research 35(5):340-350 (May 5, 2015). Published online Mar. 11, 2015.
Nidhi et al. Microparticles as controlled drug delivery carrier for the treatment of ulcerative colitis: A brief review. Saudi Pharm J 24:458-72 (2016). Available online Oct. 22, 2014.
O'Farrell et al. IL-10 inhibits macrophage activation and proliferation by distinct signaling mechanisms: evidence for Stat3-dependent and -independent pathways. The EMBO Journal 17(4):1006-1018(1998).
Olszak et al. Protective mucosal immunity mediated by epithelial CD1d and IL-10. Nature. May 22, 2014; 509(7501): 497-502. Published online Apr. 6, 2014. doi: 10.1038/nature13150.
Osei-Yeboah et al. A top coating strategy with highly bonding polymers to enable direct tableting of multiple unit pellet system (MUPS). Powder Technology 305:591-596 (2017). Available online Oct. 19, 2016.
Ostanin et al. T cell transfer model of chronic colitis: concepts, considerations, and tricks of the trade. Am J Physiol Gastrointest Liver Physiol. Feb. 2009; 296(2): G135-G146. Published online Nov. 2, 20085. doi: 10.1152/ajpgi.90462.2008.
Parasrampuria et al. Evaluation of regional gastrointestinal absorption of edoxaban using the enterion capsule. Clinical Pharmacology 55(11):1286-1292 (Nov. 2015).
Pastan et al. Recombinant Toxins as Novel Therapeutic Agents. Annu Rev Biochem 61:331-54 (1992).
Paul et al. Inflamed gut mucosa: downstream of interleukin-10. Eur J Clin Invest 42(1):95-109 (Jan. 2012). Epub Jun. 1, 2011.
PCT/US2019/021474 International Preliminary Report on Patentability dated Sep. 8, 2020.
PCT/US2019/021474 International Search Report and Written Opinion dated Jun. 11, 2019.
PCT/US2020/046545 International Search Report and Written Opinion dated Dec. 7, 2020.
Picker. Influence of tableting on the enzymatic activity of different α-amylases using various excipients. European Journal of Pharmaceutics and Biopharmaceutics 53(2):181-185 (2002).
Porat. Accelerating Development of a Novel Chimera Protein through the Identification of a Two Column Purification Process Using NH2-750F and CaPure Resins. San Francisco, CA, United States.(Presentation.) (Nov. 7, 2018.) 30 pages.
Purdy et al. A Glimpse into the Expanded Genome Content of Vibrio cholerae through Identification of Genes Present in Environmental Strains. Journal of Bacteriology 187(9):2992-3001 (May 2005). DOI: 10.1128/JB.187.9.2992-3001.2005.
Purdy et al. Diversity and distribution of cholix toxin, a novel ADP-ribosylating factor from Vibrio cholerae. Environmental Microbiology Reports 2(1):198-207 (Feb. 2010). First published Feb. 8, 2010. DOI: https://doi.org/10.1111/j.1758-2229.2010.00139.x.
Quiros et al. Macrophage-derived IL-10 mediates mucosal repair by epithelial WISP-1 signaling. J Clin Invest. Sep. 2017;127(9):3510-3520.
Randhawa et al. A Review on Chemical-Induced Inflammatory Bowel Disease Models in Rodents. Korean J Physiol Pharmacol. Aug. 2014; 18(4): 279-288.
Roberts. Therapeutic protein aggregation: mechanisms, design, and control. Trends in Biotechnology 32(7):372-380 (Jul. 2014).
Rodighiero, et al. Structural Basis for the Differential Toxicity of Cholera Toxin and *Escherichia coli* Heat-labile Enterotoxin. The Journal of Biological Chemistry 274.77 (1999): 3962-3969.
Rojas et al. Recirculating Intestinal IgA-Producing Cells Regulate Neuroinflammation via IL-10. Cell 176:1-15 (Jan. 24, 2019). DOI https://doi.org/10.1016/j.cell.2018.11.035.
Rosenblum et al. Preclinical Safety Evaluation of Recombinant Human Interleukin-10. Regulatory Toxicology and Pharmacology 35:56-71 (2002). doi:10.1006/rtph.2001.1504.
Rubas et al. An integrated method to determine epithelial transport and bioactivity of oral drug candidates in vitro. Pharm Res 13(1):23-26 (Jan. 1996).
Sarnovsky, et al. Initial characterization of an immunotoxin constructed from domains II and III of cholera exotoxin. Cancer Immunol. Immunother., 59.5 2010 (published online Nov. 2009):737-746.
Schauer. AVX-470, an Orally-Delivered GI-Targeted anti-TNF for the Treatment of Pediatric IBD. Presentation. Avaxia Biologies (Oct. 26, 2015). 42 pages.
Schiff. Role of interleukin 1 and interleukin 1 receptor antagonist in the mediation of rheumatoid arthritis. Ann Rheum Dis 59(suppl I):i103-i108 (2000).
Schülke et al. Induction of Interleukin-10 Producing Dendritic Cells As a Tool to Suppress Allergen-Specific T Helper 2 Responses. Front Immunol. 2018; 9: 455. Published online Mar. 19, 2018. doi: 10.3389/fimmu.2018.00455. 18 pages.
Schreiber et al. G4424: Safety and tolerance of rHulL-10 treatment in patients with mild/moderate active ulcerative colitis. Gastroenterology vol. 114, Supplement 1, pp. A1080-A1081 (Apr. 15, 1998). DOI: https://doi.org/10.1016/S0016-5085(98)84395-3.
Schreiber et al. Immunoregulatory Role of Interleukin 10 in Patients With Inflammatory Bowel Disease. Gastroenterology 108:1434-1444 (1995).
Schreiber et al. Safety and Efficacy of Recombinant Human Interleukin 10 in Chronic Active Crohn's Disease. Gastroenterology 119:1461-1472 (2000).
Schwager et al. Preclinical characterization of DEKAVIL (F8-IL10), a novel clinical-stage immunocytokine which inhibits the progression of collagen-induced arthritis. Arthritis Research & Therapy 11:R142 (Sep. 25, 2009). 15 pages, doi: 10.1186/ar2814.
Shah et al. Interleukin-10 and Interleukin-10-Receptor Defects in Inflammatory Bowel Disease. Current Allergy and Asthma Reports 12:373-379 (2012). Published online Aug. 14, 2012.
Shealy et al. Anti-TNF antibodies: lessons from the past, roadmap for the future. Handb Exp Pharmacol181:101-129 (2008).

(56) References Cited

OTHER PUBLICATIONS

Shouval et al. Interleukin-10 Receptor Signaling in Innate Immune Cells Regulates Mucosal Immune Tolerance and Anti-Inflammatory Macrophage Function. Immunity 40:706-719 (May 15, 2014).
Siegall et al. Functional Analysis of Domains II, Ib, and III of Pseudomonas Exotoxin. J Biol Chem 264(24):14256-14261 (Aug. 25, 1989).
Simmons et al. Immunomodulation Using Bacterial Enterotoxins. Scand J Immunol 53:518-226 (2001).
Simon, et al. Novel bacterial ADP-ribosylating toxins: structure and function. Nature Reviews Microbiology 12.9 (2014): 599-611.
Sims et al. The IL-1 family: regulators of immunity. Nature Reviews Immunology 10:89-102 (Feb. 2010). Published online Jan. 18, 2010.
Soendergaard et al. Alpha-1 antitrypsin and granulocyte colony-stimulating factor as serum biomarkers of disease severity in ulcerative colitis. Inflamm Bowel Dis May 2015;21(5):1077-88. doi: 10.1097/MIB.0000000000000348. Published online Mar. 23, 2015.
Song et al. Oral delivery system for low molecular weight protamine-dextran-poly(lactic-co-glycolic acid) carrying exenatide to overcome the mucus barrier and improve intestinal targeting efficiency. Nanomedicine (Lond.) 14(8):989-1009 (Apr. 2019). Published online Mar. 22, 2019.
Sonnenberg et al. Border patrol: regulation of immunity, inflammation and tissue homeostasis at barrier surfaces by IL-22. Nature Immunology 12(5):383-390 (May 2011). Published online Apr. 19, 2011. doi:10.1038/ni.2025.
Stevens et al. P161 Faecal calprotectin identifies microscopic inflammation in ulcerative colitis patients with complete endoscopic healing: a post-hoc analysis of the MOMENTUM trial. Journal of Crohn's and Colitis, vol. 13, Issue Supplement_1, Mar. 2019, p. S169,https://doi.org/10.1093/ecco-jcc/jjy222.285. Published onlineJan. 25, 2019.
Suchaoin et al. Nanocarriers protecting toward an intestinal pre-uptake metabolism. Nanomedicine (Lond.) 12(3):255-269 (2017). Published online Jan. 17, 2017.
Sugisawa et al. Comparative study of high viscosity grade of hydroxypropyl cellulose (HPC-H) for hydrophilic matrix, sustained release formulation. 2012 AAPS Annual Meeting and Exposition Poster #T2133 (2012). One page.
Sun et al. Cholera toxin B subunit: An efficient transmucosal carrier-delivery system for induction of peripheral immunological tolerance. Proc Natl Acad Sci USA 91:10795-10799 (Nov. 1994).
Takeuchi et al. Mucoadhesive nanoparticulate systems for peptide drug delivery. Adv Drug Deliv Rev 47(1):39-54 (Mar. 23, 2001).
Taupiac et al. A deletion within the translocation domain of Pseudomonas exotoxin A enhances translocation efficiency and cytotoxicity concomitantly. Molecular Microbiology 31(5):1385-1393 (1999).
Taverner et al. Cholix protein domain I functions as a carrier element for efficient apical to basal epithelial transcytosis. Tissue Barriers, p. 1710429-1 to 1710429-20 (Jan. 13, 2020). doi: 10.1080/21688370.2019.1710429.
Thakral et al. Eudragit®: a technology evaluation. Expert Opin Drug Deliv 10(1):131-49 (2013). Epub Oct. 26, 2012.
The Facts About Inflammatory Bowel Diseases. Crohn's & Colitis Foundation of America. Nov. 2014. 24 pages. Retrieved Nov. 25, 2020 at URL: https://www.crohnscolitisfoundation.org/sites/default/files/2019-02/Updated%20IBD%20Factbook.pdf.
Thoma et al. Enteric coated hard gelatin capsules. Capsugel (2000). 17 pages.
Turgeon et al. Yeast as a tool for characterizing mono-ADP-ribosyltransferase toxins. FEMS Microbiology Letters 300(1):97-106 (Nov. 2009). Published online Sep. 28, 2009. DOI: https://doi.org/10.1111/j.1574-6968.2009.01777.x.
Van Deventer et al. Multiple Doses of Intravenous Interleukin 10 in Steroid-Refractory Crohn's Disease. Gastroenterology 113(2):383-389 (1997).
Vermeire et al. C-reactive protein as a marker for inflammatory bowel disease. Inflamm Bowel Dis. Sep. 2004;10(5):661-5.
Wahlich et al. Nanomedicines for the Delivery of Biologies. Pharmaceutics. May 2019; 11(5): 210. Published online May 3, 2019. doi: 10.3390/pharmaceutics11050210. 14 pages.
Wang et al. The effect of IL-10 genetic variation and interleukin 10 serum levels on Crohn's disease susceptibility in a New Zealand population. Hum Immunol. May 2011;72(5):431-5.doi: 10.1016/j.humimm.2011.02.014. Epub Feb. 25, 2011.
Wei et al. Developing Biologies Tablets: The Effects of Compression on the Structure and Stability of Bovine Serum Albumin and Lysozyme. Mol. Pharmaceutics 16(3):1119-1131 (Jan. 30, 2019).
Weldon, et al. A guide to taming a toxin-recombinant immunotoxins constructed from Pseudomonas exotoxin A for the treatment of cancer. FEBS Journal 278.23 (2011): 4683-4700.
Wilding et al. The role of gamma-scintigraphy in oral drug delivery. Adv Drug Deliv Rev 46:103-124(2001).
Williams et al. Prevention of autoimmune disease due to lymphocyte modulation by the B-subunit of *Escherichia coli* heat-labile enterotoxin. Proc Natl Acad Sci USA 94:5290-5295 (May 1997).
Wingfield. N-Terminal Methionine Processing. Curr Protoc Protein Sci 88:6.14.1-6.14.3 (2017). First published Apr. 3, 2017. doi:10.1002/cpps.29.
Wolk et al. Is there an interaction between interleukin-10 and interleukin-22? Genes and Immunity 6:8-18 (2005).
Wolk et al. Cutting edge: immune cells as sources and targets of the IL-10 family members? J Immunol 168(11):5397-5402 (2002).
Woodley, J.F. Enzymatic barriers for GI peptide and protein delivery. Crit Rev Ther Drug Carrier Syst. 1994;11(2-3):61-95.
Wu et al. Polymer-Based Sustained-Release Dosage Forms for Protein Drugs, Challenges, and Recent Advances. AAPS PharmSciTech 9(4):1218-1229 (Dec. 2008). Published online Dec. 16, 2008.
Wu. Identification of Endoplasmic Reticulum Export Motifs for G Protein-Coupled Receptors. Methods in Enzymol 521:189-202 (2013). DOI: https://doi.org/10.1016/B978-0-12-391862-8.00010-7.
Wu. Regulation of α2B-Adrenergic Receptor Export Trafficking by Specific Motifs. Prog Mol Biol Transl Sci 132:227-244 (2015). DOI: https://doi.org/10.1016/bs.pmbts.2015.03.004.
Yahiro et al. Cholix toxin, an eukaryotic elongation factor 2 ADP-ribosyltransferase, interacts with Prohibitins and induces apoptosis with mitochondrial dysfunction in human hepatocytes. Cell Microbiol. Aug. 2019;21(8):e13033.doi: 10.1111/cmi.13033. Epub May 14, 2019.
Yates, et al. Stealth and Mimicry by Deadly Bacterial Toxins. Trends Biochemical Science 31 (2006): 123-133.
Yoon et al. Conformational Changes Mediate Interleukin-10 Receptor 2 (IL-10R2) Binding to IL-10 and Assembly of the Signaling Complex. J Biol Chem 281(46):35088-35096 (Sep. 18, 2006). DOI: 10.1074/jbc.M606791200.
Zdanov et al. Crystal structure of interleukin-10 reveals the functional dimer with an unexpected topological similarity to interferon γ. Structure 3(6):591-601 (Jun. 15, 1995).
Zdanov. Structural analysis of cytokines comprising the IL-10 family. Cytokine & Growth Factor Reviews 21(5):325-330 (Oct. 2010). Available online Sep. 16, 2010. DOI: https://doi.org/10.1016/j.cytogfr.2010.08.003.

* cited by examiner

| Solid Dose compacting | Control | Preblending | Ribbon low density | Ribbon high density | Granule low density | Granule high density | Cleo Tablet |
|---|---|---|---|---|---|---|---|
| F1 Formulation | 79.5 | 81.3 | 79.2 | 79.5 | 79.6 | 78.5 | 73.9 |
| F2 Formulation | 79.5 | 78.9 | 78.4 | 79.2 | 79.5 | 78.5 | 69.4 |

IL-10 CD11c DAPI

Cholix CD3 DAPI

NAÏVE
(NO DISEASE)

DISEASE:
VEHICLE/PLACEBO TREATED

DISEASE:
TREATED WITH SEQ ID NO: 5

SEQ ID NO: 5

T cells (CD3)

COMPOSITIONS, FORMULATIONS AND INTERLEUKIN PRODUCTION AND PURIFICATION

CROSS-REFERENCE

This application is a continuation application of International Patent Application No. PCT/US2020/046545, filed Aug. 14, 2020, which claims the benefit of U.S. Provisional Application No. 62/888,144, filed Aug. 16, 2019, U.S. Provisional Application No. 62/888,237, filed Aug. 16, 2019, U.S. Provisional Application No. 62/986,579, filed Mar. 6, 2020, U.S. Provisional Application No. 62/887,963, filed Aug. 16, 2019, U.S. Provisional Application No. 62/887,933, filed Aug. 16, 2019, U.S. Provisional Application No. 62/898,934, filed Sep. 11, 2019, U.S. Provisional Application No. 62/971,126, filed Feb. 6, 2020, U.S. Provisional Application No. 62/898,709, filed Sep. 11, 2019, U.S. Provisional Application No. 62/898,729, filed Sep. 11, 2019, U.S. Provisional Application No. 62/939,495, filed Nov. 22, 2019, U.S. Provisional Application No. 62/970,627, filed Feb. 5, 2020, U.S. Provisional Application No. 63/020,996, filed May 6, 2020, U.S. Provisional Application No. 63/033,077, filed Jun. 1, 2020, U.S. Provisional Application No. 62/898,899, filed Sep. 11, 2019; U.S. Provisional Application No. 63/013,309, filed Apr. 21, 2020; U.S. Provisional Application No. 62/986,557 filed Mar. 6, 2020; and U.S. Provisional Application No. 63/055,886, filed Jul. 23, 2020; which applications are incorporated herein by reference.

SEQUENCE LISTING

The instant application contains a Sequence Listing which has been submitted electronically in ASCII format and is hereby incorporated by reference in its entirety. Said ASCII copy, created on Aug. 12, 2020, is named 40566-721_601_SL.txt and is 729,437 bytes in size.

BACKGROUND OF THE INVENTION

While oral administration can be a convenient and desirable route for the administration of protein pharmaceuticals, challenges presented by this administration route include the acidic environment of the stomach, which can cause denaturation of protein structure, including dimers, and hydrolysis of chemical bonds, variable pH across various regions of the gastrointestinal tract, and the presence of proteolytic enzymes which are secreted into the GI tract and break down proteins into smaller fragments. Furthermore, even if protein pharmaceuticals are able to survive these challenges and arrive intact in the lower GI tract, it can be difficult for such pharmaceuticals to cross the intestinal epithelium due to their large size.

Additionally, some therapeutic proteins are active (or more active) in the dimer form. Thus, their therapeutic utility may be compromised when produced or formulated in a manner that does not result in proper dimerization. Common purification and processing protocols may prevent the desired dimer formation, resulting in (for example) an excessively high proportion of monomers or aggregates.

SUMMARY OF THE INVENTION

Described herein, in certain embodiments, are delivery constructs consisting of an amino acid sequence set forth in SEQ ID NO: 5 or SEQ ID NO: 13. In some embodiments, the delivery construct consists of the amino acid sequence set forth in SEQ ID NO: 5. In some embodiments, the delivery construct consists of the amino acid sequence set forth in SEQ ID NO: 13. In some embodiments, the delivery construct is part of a homodimer. In some embodiments, the delivery construct is disposed within a composition that is formulated for oral administration, wherein the composition for oral administration comprises a plurality of delivery constructs identical to the delivery construct, and wherein at least 80% of the delivery constructs are in a dimer form.

Described herein, in certain embodiments, are methods of treating an inflammatory disease in a subject, the method comprising administering to the subject an effective amount of a delivery construct as described herein. In some embodiments, the inflammatory disease is ulcerative colitis, proctitis, pouchitis, Crohn's disease, multiple sclerosis (MS), systemic lupus erythematosus (SLE), graft versus host disease (GVHD), rheumatoid arthritis, inflammatory bowel disease (IBD), Celiac disease, psoriatic arthritis, or psoriasis. In some embodiments, the inflammatory disease is ulcerative colitis. In some embodiments, the inflammatory disease is Crohn's disease. In some embodiments, the inflammatory disease is celiac disease.

Described herein, in certain embodiments, are methods of refolding an IL-10 delivery construct, the method comprising: (i) contacting inclusion bodies comprising the IL-10 delivery construct with a solubilization solution comprising a chaotropic agent to produce a soluble IL-10 delivery construct; (ii) contacting the soluble IL-10 delivery construct with a refolding solution comprising reduced glutathione and oxidized glutathione to produce a refolded IL-10 delivery construct; wherein the method does not comprise contacting the soluble IL-10 delivery construct with a sulfitolysis agent or a reducing agent prior to the contacting of step (ii). In some embodiments, the IL-10 delivery construct comprises a carrier. In some embodiments, the carrier is derived from a polypeptide secreted by a bacterium. In some embodiments, the bacterium is *Vibrio cholerae*. In some embodiments, the polypeptide secreted by *Vibrio cholerae* is a cholix polypeptide. In some embodiments, the IL-10 delivery construct has at least 80%, 85%, 90%, 92%, 94%, 95%, 96%, 97%, 98%, 99%, or 100% sequence identity to an amino acid sequence set forth in SEQ ID NO: 5. In some embodiments, the IL-10 delivery construct has a V1L substitution at amino acid position 1 of the carrier.

In some embodiments, the refolding solution comprises a ratio of the reduced glutathione to the oxidized glutathione from 0.8:1 to 1.2:1. In some embodiments, the refolding solution comprises from 0.75 mM to 1.5 mM reduced glutathione. In some embodiments, the refolding solution comprises from 0.25 mM to 0.75 mM oxidized glutathione. In some embodiments, the refolding solution has a pH from 7.5 to 8.5. In some embodiments, the refolding solution comprises arginine, Tris, and EDTA. In some embodiments, the refolding solution comprises sucrose. In some embodiments, the refolding solution comprises arginine, sucrose, Tris, EDTA, or a combination thereof. In some embodiments, arginine is present in the refolding solution at a concentration of between 900 mM and 1.1 M. In some embodiments, sucrose is present in the refolding solution at a concentration of between 200 mM and 300 mM. In some embodiments, Tris is present in the refolding solution at a concentration of from 75 mM to 125 mM. In some embodiments, EDTA is present in the refolding solution at a concentration of from 1.75 mM to 2.25 mM.

In some embodiments, the method further comprises lysing a cell comprising the inclusion bodies. In some embodiments, the cell is a bacterium. In some embodiments, the bacterium is *Escherichia coli*. In some embodiments, the lysing comprises high-pressure homogenization. In some embodiments, the method further comprises isolating the inclusion bodies. In some embodiments, the chaotropic agent comprises guanidine hydrochloride or urea. In some embodiments, the solubilization solution further comprises Tris. In some embodiments, the contacting the soluble IL-10 delivery construct with a refolding solution occurs for at least 16 hours. In some embodiments, the contacting the soluble IL-10 delivery construct with a refolding solution occurs from 12 hours to 18 hours.

In some embodiments, the contacting the IL-10 delivery construct with a refolding solution occurs from 2° C. to 8° C. In some embodiments, the method further comprises a first sterile filtration of the refolded IL-10 delivery construct. In some embodiments, the first sterile filtration occurs after the contacting with the refolding solution. In some embodiments, the method further comprises performing a tangential flow filtration of the refolded IL-10 delivery construct. In some embodiments, the tangential flow filtration comprises diafiltration. In some embodiments, the diafiltration comprises a first diavolume, a second diavolume, a third diavolume, and a fourth diavolume. The In some embodiments, the first diavolume and the second diavolume comprise a cold buffer. In some embodiments, the third diavolume and the fourth diavolume comprise a room temperature buffer. In some embodiments, the cold buffer and the room temperature buffer comprise Tris and NaCl.

Described herein, in certain embodiments, are methods of enriching for IL-10 delivery construct dimers from a pool comprising IL-10 delivery constructs in a dimer form, a monomer form, and an aggregate form, the method comprising: (i) performing anion exchange (AEX) chromatography on the pool by binding the IL-10 delivery construct dimers to an anion exchange column and subsequently eluting the IL-10 delivery construct dimers from the anion exchange column, thereby creating a first plurality of fractions, one of which is a first fraction enriched in IL-10 delivery constructs in the dimer form; and (ii) performing ceramic hydroxyapatite (CHT) chromatography on the fraction enriched in IL-10 delivery constructs in the dimer form, thereby creating a second plurality of fractions, one of which is a second fraction further enriched in IL-10 delivery constructs in the dimer form. In some embodiments, the IL-10 delivery construct comprises a carrier. In some embodiments, the carrier is derived from a polypeptide secreted by a bacterium. In some embodiments, the bacterium is *Vibrio cholerae*. In some embodiments, the polypeptide secreted by *Vibrio cholerae* is a cholix polypeptide. In some embodiments, the IL-10 delivery construct has at least 80%, 85%, 90%, 92%, 94%, 95%, 96%, 97%, 98%, 99%, or 100% sequence identity to an amino acid sequence set forth in SEQ ID NO: 5. In some embodiments, the IL-10 delivery construct has a V1L substation at amino acid position 1 of the carrier. In some embodiments, the method further comprises determining a percentage of IL-10 delivery constructs in the dimer form in each fraction of the first plurality of fractions. In some embodiments, the determining is by size exclusion chromatography. In some embodiments, the size exclusion chromatography is size exclusion high performance liquid chromatography (SE-HPLC). In some embodiments, the method further comprises determining a percentage of IL-10 delivery constructs in the dimer form in each fraction of the second plurality of fractions. In some embodiments, the determining is by size exclusion chromatography. In some embodiments, the size exclusion chromatography is size exclusion high performance liquid chromatography (SE-HPLC). In some embodiments, at least 75% of the IL-10 delivery constructs in the first fraction are IL-10 delivery constructs in the dimer form. In some embodiments, at least 80% of the IL-10 delivery constructs in the second fraction are IL-10 delivery constructs in the dimer form. In some embodiments, the method further comprises performing tangential flow filtration of the second fraction. In some embodiments, the tangential flow filtration comprises ultrafiltration. In some embodiments, the method further comprises diafiltration. In some embodiments, the method further comprises performing sterile filtration the second fraction. In some embodiments, the method does not comprise cation exchange chromatography. In some embodiments, the pool comprises refolded IL-10 delivery constructs.

Described herein, in certain embodiments, are oral formulations comprising: (a) IL-10 delivery constructs; (b) one or more pharmaceutically acceptable excipients; and (c) a first coat comprising two or more copolymers each having a different nominal dissolution pH; wherein the oral formulation is configured to release substantially none of the IL-10 delivery construct after 1 h exposure to a solution having a pH of 1.0 in a Type 4 dissolution apparatus in open mode. In some embodiments, the solution having the pH of 1.0 is a dissolution media containing hydrochloric acid. In some embodiments, the oral formulation is configured to release at least 40% of the IL-10 delivery construct after 2 hours of exposure to a solution having a pH of 7.0 in a Type 4 dissolution apparatus in open mode. In some embodiments, at least 5%, at least 10%, at least 20%, or at least 25% of the IL-10 delivery constructs released following 2 hours of exposure to the solution having the pH of 7.0 are in a dimer form. In some embodiments, the solution having the pH of 7.0 is a citrate/phosphate buffer. In some embodiments, the IL-10 delivery construct comprises a carrier. In some embodiments, the carrier is derived from a polypeptide secreted by a bacterium. In some embodiments, the bacterium is *Vibrio cholerae*. In some embodiments, the polypeptide secreted by *Vibrio cholerae* is a cholix polypeptide.

In some embodiments, the IL-10 delivery constructs have at least 80%, 85%, 90%, 92%, 94%, 95%, 96%, 97%, 98%, 99%, or 100% sequence identity to an amino acid sequence set forth in SEQ ID NO: 5. In some embodiments, the IL-10 delivery constructs have a V1L substitution at amino acid position 1 of the carrier. In some embodiments, the oral formulation is in a capsule or a tablet. In some embodiments, a first copolymer has at least 50% nominal dissolution at pH >5.5 and a second copolymer has at least 50% nominal dissolution at pH >7.0. In some embodiments, the first copolymer comprises methacrylic acid and ethyl acrylate. In some embodiments, the first polymer has a weight average molecular mass of from 200,000 g/mol to 450,000 g/mol, or from 250,000 g/mol to 400,000 g/mol, or from 280,000 g/mol to 370,000 g/mol, or from 300,000 g/mol to 340,000 g/mol. In some embodiments, the first copolymer comprises the polymer of formula I:

Formula I

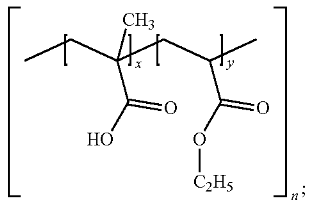

;

wherein x, y, and n are each greater than or equal to one.

In some embodiments, a ratio of free carboxyl groups to ester groups in the first copolymer is from 0.8:1 and 1.2:1. In some embodiments, the second copolymer is different from the first copolymer. In some embodiments, a ratio of the first copolymer to the second copolymer in the first coat is from 15:85 to 55:45. In some embodiments, a ratio of the first copolymer to the second copolymer in the first coat is 20:80, 30:70, 40:60, or 50:50. In some embodiments, the second copolymer comprises methacrylic acid, methyl methacrylate, and methyl acrylate. In some embodiments, the second polymer has a weight average molecular mass of from 160,000 g/mol to 400,000 g/mol or from 200,000 g/mol to 360,000 g/mol, or from 240,000 g/mol to 320,000 g/mol, or from 260,000 g/mol to 300,000 g/mol. In some embodiments, wherein the second copolymer comprises the polymer of formula II:

Formula II

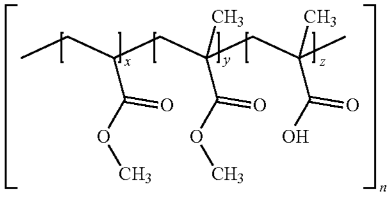

wherein x, y, z, and n are each greater than or equal to one.

In some embodiments, a ratio of free carboxyl groups to ester groups in the second copolymer is from 0.8:1 to 1.2:1. In some embodiments, the first coat further comprises an anti-tacking agent, a plasticizer, a surfactant, or a combination thereof. In some embodiments, the first coat comprises an anti-tacking agent, wherein the anti-tacking agent comprises glycerol monostearate. In some embodiments, the first coat comprises a plasticizer, wherein the plasticizer is triethyl citrate. In some embodiments, the first coat comprises a surfactant, wherein the surfactant is polysorbate 80. In some embodiments, from 5% to 15% (w/w) of the first coat is a mixture of glycerol monostearate, triethyl citrate, and polysorbate 80. In some embodiments, the first coat has a thickness substantially equivalent to the thickness of a 60 mg coat on a size 1 capsule. In some embodiments, the first coat is disposed around an interior portion in an amount from 0.1 mg/mm2 to 0.2 mg/mm2. In some embodiments, the first coat has a mass from 30 mg to 60 mg. In some embodiments, the oral formulation further comprises a second coat exterior of the first coat. In some embodiments, the second coat comprises hydroxypropyl methylcellulose (HPMC). In some embodiments, the oral formulation further comprising a third coat interior to the first coat and exterior of the IL-10 delivery constructs and the one or more pharmaceutically acceptable excipients. In some embodiments, the third coat comprises HPMC.

In some embodiments, the IL-10 delivery constructs are present in the oral formulation in an amount from 1 mg to 20 mg. In some embodiments, the IL-10 delivery constructs are present in the oral formulation in an amount of 1 mg, 5 mg, or 20 mg. In some embodiments, the one or more pharmaceutically acceptable excipients comprise a surfactant, an osmolyte, a salt, and a bulking agent. In some embodiments, the salt comprises potassium phosphate, the bulking agent comprises glycine, the osmolyte comprises sucrose, and the surfactant comprises poloxamer 188. In some embodiments, the oral formulation comprises a weight ratio of the osmolyte to the IL-10 delivery construct of from 0.45:1 to 0.55:1, preferably about 0.5:1. In some embodiments, the oral formulation comprises a weight ratio of the surfactant to the IL-10 delivery construct of from 0.12:1 to 0.18:1, preferably about 0.15:1. In some embodiments, the oral formulation comprises a weight ratio of the salt to the IL-10 delivery construct of from 0.05:1 to 0.09:1, preferably about 0.07:1. In some embodiments, the oral formulation comprises a weight ratio of the bulking agent to the IL-10 delivery construct of from 0.8:1 to 1.2:1, preferably about 1:1. In some embodiments, the oral formulation is a solid. In some embodiments, the oral formulation is in a unit dose form. In some embodiments, the oral formulation has a shelf-life of at least 3 months, at least 6 months, at least 12 months, at least 18 months, or at least 24 months. In some embodiments, the one or more pharmaceutically acceptable excipients comprise a potassium salt, glycine, sucrose or trehalose, and a poloxamer, wherein the poloxamer has a weight average molecular mass of from 15,000 to 25,000 daltons and a polyoxythylene content of from 70% to 90% by weight; and wherein the oral formulation further comprises: (c) a first coat comprising a first copolymer, wherein the first copolymer comprises a polymer of formula I:

Formula I

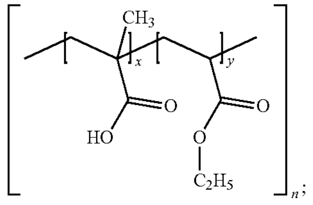

wherein x, y, and n are each greater than or equal to one; and further comprises a second copolymer, wherein the second copolymer comprises a polymer of formula II:

Formula II

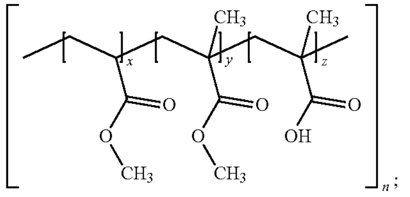

wherein x, y, z, and n are each greater than or equal to one; wherein a ratio of the first copolymer to the second copolymer is 30:70; and wherein the first coat further comprises from 5% to 15% (w/w) of a mixture of glycerol monostearate, triethyl citrate, and polysorbate 80; (d) a second coat comprising HPMC positioned exterior of the first coat; and (e) a third coat comprising HPMC positioned interior of the first coat and exterior of the therapeutic payload and the one or more pharmaceutically acceptable excipients.

Described herein, in certain embodiments, are solid compositions comprising: IL-10 delivery constructs; and one or more excipients; wherein each of the IL-10 delivery constructs comprises IL-10 coupled to a carrier that promotes transcytosis of the IL-10 delivery construct across a polarized gut epithelial cell; and wherein greater than 80% of the IL-10 delivery constructs are in a dimer form. In some embodiments, the solid composition is lyophilized or spray dried. In some embodiments, the solid composition is a tablet or a capsule. In some embodiments, the one or more pharmaceutically acceptable excipients comprise a surfactant. In some embodiments, the surfactant is a poloxamer. In some embodiments, the poloxamer is poloxamer 188. In some embodiments, the surfactant does not include a polysorbate. In some embodiments, the one or more pharmaceutically acceptable excipients comprise an osmolyte. In some embodiments, the osmolyte is sucrose. In some embodiments, the one or more pharmaceutically acceptable excipients comprise a salt. In some embodiments, the salt is potassium phosphate. In some embodiments, the one or more pharmaceutically acceptable excipients comprise a bulking agent. In some embodiments, the bulking agent is glycine. In some embodiments, the IL-10 has at least 80%, 85%, 90%, 92%, 94%, 95%, 96%, 97%, 98%, 99%, or 100% sequence identity to an amino acid sequence set forth in SEQ ID NO: 2. In some embodiments, the IL-10 is coupled to the carrier via a linker. In some embodiments, the linker comprises an amino acid sequence set forth in SEQ ID NO: 6. In some embodiments, the carrier comprises an amino acid sequence set forth in SEQ ID NO: 4. In some embodiments, the carrier comprises an amino acid sequence set forth in SEQ ID NO: 12. In some embodiments, the IL-10 delivery construct has at least 80%, 85%, 90%, 92%, 94%, 95%, 96%, 97%, 98%, 99%, or 100% sequence identity to an amino acid sequence set forth in SEQ ID NO: 5. In some embodiments, the IL-10 delivery construct has a V1L substitution at amino acid position 1 of the carrier.

In some embodiments, greater than 81%, 82%, 83%, 84%, 85%, 86%, 87%, 88%, 89%, or 90% of the IL-10 delivery constructs are in a dimer form. In some embodiments, from 85% to 92% of the IL-10 delivery constructs are in a dimer form. In some embodiments, the solid composition comprises a first coat. In some embodiments, the first coat comprises a first copolymer and a second copolymer, wherein the first coat is external of the IL-10 delivery constructs and one or more excipients. In some embodiments, the first copolymer comprises methacrylic acid and ethyl acrylate. In some embodiments, the second copolymer comprises methacrylic acid, methyl methacrylate, and methyl acrylate. In some embodiments, a ratio of the first copolymer to the second copolymer in the first coat is from about 15:85 to about 55:45. In some embodiments, a ratio of the first copolymer to the second copolymer in the first coat is 20:80, 30:70, 40:60, or 50:50. In some embodiments, the solid composition further comprises a second coat exterior of the first coat. In some embodiments, the second coat comprises hydroxypropyl methylcellulose (HPMC). In some embodiments, the solid composition further comprises a third coat interior to the first coat and exterior of the IL-10 delivery constructs and the one or more excipients. In some embodiments, the third coat comprises HPMC.

Described herein, in certain embodiments, are solid oral formulations comprising: (a) an IL-10 delivery construct comprising IL-10 coupled to a carrier that promotes transcytosis of IL-10 delivery construct across a polarized gut epithelial cell; and (b) one or more pharmaceutically acceptable excipients, wherein the one or more pharmaceutically acceptable excipients comprise a non-ionic lubricant; and (c) a first coat surrounding the IL-10 delivery construct and the one or more pharmaceutically acceptable excipients. In some embodiments, the non-ionic lubricant is glyceryl behenate. In some embodiments, the oral formulation lacks magnesium stearate. In some embodiments, the oral formulation is in a tablet form. In some embodiments, the oral formulation is configured such that substantially none of the IL-10 delivery construct is released from the oral formulation after 1 h exposure to a solution at pH 1.0 in a Type 4 dissolution apparatus in open mode. In some embodiments, the oral formulation is configured to release at least 40% of the IL-10 delivery construct after 2 hours of exposure to a solution at pH 7.0 in a Type 4 dissolution apparatus in open mode. In some embodiments, the oral formulation further comprises a first coat comprising two or more copolymers each having a different nominal dissolution pH. In some embodiments, at least 45% of the IL-10 delivery construct is in a dimer form. In some embodiments, the one or more pharmaceutically acceptable excipients comprise a bulking agent, a disintegrant, or a combination thereof. In some embodiments, the bulking agent is silicified microcrystalline cellulose (SMCC). In some embodiments, the disintegrant is crospovidone (crosslinked polyvinylpyrrolidone). In some embodiments, the IL-10 delivery construct has at least 80%, 85%, 90%, 92%, 94%, 95%, 96%, 97%, 98%, 99%, or 100% sequence identity to an amino acid sequence set forth in SEQ ID NO: 5. In some embodiments, the IL-10 delivery construct has a V1L substitution at amino acid position 1 of the carrier. In some embodiments, the oral formulation is created by compression of the IL-10 delivery construct and the one or more pharmaceutically acceptable excipients. In some embodiments, the compression occurs with a compression force of from about 2000 pound-force (lbf) to about 3500 lbf. In some embodiments, the first coat comprises a first copolymer and a second copolymer, wherein the first coat is external of the IL-10 delivery constructs and one or more pharmaceutically acceptable excipients. In some embodiments, the first copolymer comprises methacrylic acid and ethyl acrylate. In some embodiments, the second copolymer comprises methacrylic acid, methyl methacrylate, and methyl acrylate.

In some embodiments, a ratio of the first copolymer to the second copolymer in the first coat is from about 15:85 to about 55:45. In some embodiments, a ratio of the first copolymer to the second copolymer in the first coat is 20:80, 30:70, 40:60, or 50:50. In some embodiments, the solid oral formulation further comprises a second coat exterior of the first coat. In some embodiments, the second coat comprises hydroxypropyl methylcellulose (HPMC). In some embodiments, the solid oral formulation further comprising a third coat interior to the first coat and exterior of the IL-10 delivery constructs and the one or more pharmaceutically acceptable excipients. In some embodiments, the third coat comprises HPMC. In some embodiments, the one or more pharmaceutically acceptable excipients further comprise a potassium salt, glycine, sucrose or trehalose, and a poloxamer, wherein the poloxamer has a weight average molecular mass of from 15,000 to 25,000 daltons and a polyoxythylene content of from 70% to 90% by weight; and wherein the oral formulation further comprises: (c) a first coat comprising a first copolymer, wherein the first copolymer comprises a polymer of formula I:

Formula I

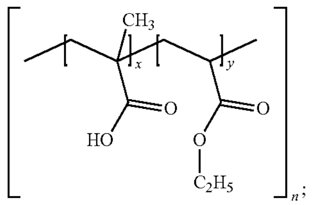

wherein x, y, and n are each greater than or equal to one; and further comprises a second copolymer, wherein the second copolymer comprises a polymer of formula II:

Formula II

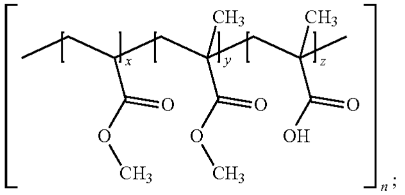

wherein x, y, z, and n are each greater than or equal to one; wherein a ratio of the first copolymer to the second copolymer is 30:70; and wherein the first coat further comprises from 5% to 15% (w/w) of a mixture of glycerol monostearate, triethyl citrate, and polysorbate 80; (d) a second coat comprising HPMC positioned exterior of the first coat; and (e) a third coat comprising HPMC positioned interior of the first coat and exterior of the therapeutic payload and the one or more pharmaceutically acceptable excipients.

Described herein, in certain embodiments, are oral formulations comprising: (a) an IL-10 and (b) one or more pharmaceutically acceptable excipients, wherein administration of a dose of the oral formulation to an individual results in an immunomodulatory response selected from the group consisting of: (i) a decrease in a concentration of fecal calprotectin (FCP) relative to an FCP baseline, (ii) a decrease in a concentration of C-Reactive Protein (CRP) relative to a CRP baseline, (iii) a decrease in a Geboes score relative to a Geboes score baseline, and (iv) a combination of (i)-(iii). In some embodiments, the immunomodulatory response comprises the decrease in FCP relative to the FCP baseline. In some embodiments, the concentration of FCP is determined from a fecal sample or a colonic biopsy. In some embodiments, the decrease in the concentration of FCP is a decrease of at least 20%, 30%, 40%, or 50% relative to the FCP baseline.

In some embodiments, the FCP baseline is an initial concentration of FCP in the individual prior to the administration. In some embodiments, the initial concentration of FCP can be indicative of a gastrointestinal indication of the individual. In some embodiments, the initial concentration of FCP is greater than 150 μg/g. The oral formulation of claim 178 or claim 179, wherein the gastrointestinal indication is ulcerative colitis (UC) or Crohn's disease. In some embodiments, the concentration of FCP is decreased at least 50% relative to the initial concentration of FCP, and the dose of the oral formulation is from about 1 mg to about 3 mg. In some embodiments, the FCP baseline is a placebo-adjusted FCP baseline. In some embodiments, the concentration of FCP is decreased at least 20% relative to the placebo-adjusted FCP baseline and the dose of the oral formulation is from about 1 mg to about 3 mg. In some embodiments, the concentration of FCP is decreased to 50 μg/g or less. In some embodiments, the immunomodulatory response comprises the decrease in the concentration of CRP relative to the CRP baseline. In some embodiments, the concentration of CRP is a systemic concentration of CRP. In some embodiments, the concentration of CRP is determined from a blood sample. In some embodiments, the decrease in the concentration of CRP is a decrease of at least 10%, 20%, 30%, 40%, 50%, 60%, 70%, or 80% relative to the CRP baseline. In some embodiments, the CRP baseline is an initial concentration of CRP in the individual prior to the administration. In some embodiments, the initial concentration of CRP is greater than 5 mg/L. In some embodiments, the initial concentration of CRP is indicative of a gastrointestinal indication of the individual.

In some embodiments, the gastrointestinal indication is irritable bowel disease (IBD). In some embodiments, the concentration of CRP is decreased at least 40% relative to the initial concentration CRP and the dose of the oral formulation is from about 1 mg to about 3 mg. In some embodiments, the CRP baseline is a placebo-adjusted CRP baseline. In some embodiments, the concentration of CRP is decreased at least 10% relative to the placebo-adjusted CRP baseline and the dose of the oral formulation is about 3 mg. In some embodiments, the concentration of CRP is decreased at least 40% relative to placebo-adjusted CRP baseline and the dose of the oral formulation is about 1 mg. In some embodiments, the concentration of CRP is decreased to less than 5 mg/L. In some embodiments, the immunomodulatory response comprises the decrease in the Geboes score relative to the Geboes score baseline. In some embodiments, the Geboes score baseline is an initial Geboes score prior to the administration. In some embodiments, the Geboes score baseline is a placebo-adjusted Geboes score baseline. In some embodiments, the Geboes score is decreased a least 2 units relative to the placebo-adjusted Geboes score baseline and the dose of the oral formulation is from about 1 mg to about 30 mg.

In some embodiments, less than 5% of the administered IL-10 enters the bloodstream of the individual. In some embodiments, the immunomodulatory response is observed after daily administration of the dose of the oral formulation for 14 days. In some embodiments, the dose of the oral formulation is 10 mg or less. In some embodiments, the dose of the oral formulation is from 1 mg to 10 mg, from 3 mg to 10 mg, or from 1 mg to 3 mg. In some embodiments, the dose of the oral formulation is 1 mg, 3 mg, or 10 mg. In some embodiments, the oral formulation is a capsule.

In some embodiments, the oral formulation is biodegradable. In some embodiments, the one or more pharmaceutically acceptable excipients comprise a surfactant. In some embodiments, the surfactant is poloxamer 188. In some embodiments, the one or more pharmaceutically acceptable excipients comprise an osmolyte. In some embodiments, the osmolyte is sucrose. In some embodiments, the one or more pharmaceutically acceptable excipients comprise a salt. In some embodiments, the salt is potassium phosphate. In some embodiments, the one or more pharmaceutically acceptable excipients comprise a bulking agent. In some embodiments, the bulking agent is glycine. In some embodiments, the oral formulation comprises a first coat, wherein the first coat is external of the IL-10 and one or more pharmaceutically acceptable excipients. In some embodiments, the first coat comprises a first copolymer comprising methacrylic acid and ethyl acrylate and a second copolymer comprising methacrylic acid, methyl methacrylate, and methyl acrylate. In some embodiments, a ratio of the first copolymer to the second copolymer in the first coat is from about 15:85 to 55:45. In some embodiments, a ratio of the first copolymer to the second copolymer in the first coat is 20:80, 30:70, 40:60, or 50:50.

In some embodiments, the oral formulation further comprises a second coat located interior of the first coat and external of the IL-10 and one or more pharmaceutically acceptable excipients. In some embodiments, the second coat comprises hydroxypropyl methylcellulose (HPMC). In some embodiments, the oral formulation further comprises a third coat interior to the first coat and exterior of the IL-10 and the one or more pharmaceutically acceptable excipients. In some embodiments, the third coat comprises HPMC. In some embodiments, the IL-10 is part of an IL-10 delivery construct having at least 80%, 85%, 90%, 92%, 94%, 95%, 96%, 97%, 98%, 99%, or 100% sequence identity to an amino acid sequence set forth in SEQ ID NO: 5. In some embodiments, the IL-10 delivery construct comprises a carrier. In some embodiments, the IL-10 delivery construct has a V1L substitution at amino acid position 1 of the carrier. In some embodiments, the one or more pharmaceutically acceptable excipients comprise a potassium salt, glycine, sucrose or trehalose, and a poloxamer, wherein the poloxamer has a weight average molecular mass of from 15,000 to 25,000 daltons and a polyoxythylene content of from 70% to 90% by weight; and wherein the oral formulation further comprises: (c) a first coat comprising a first copolymer, wherein the first copolymer comprises a polymer of formula I:

Formula I

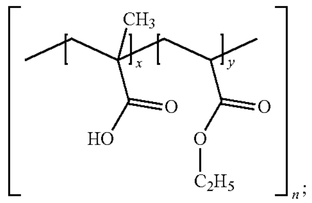

wherein x, y, and n are each greater than or equal to one; and further comprises a second copolymer, wherein the second copolymer comprises a polymer of formula II:

Formula II

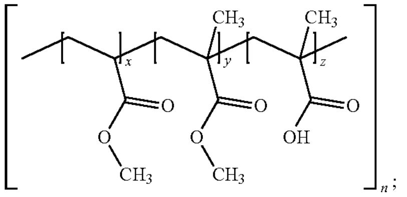

wherein x, y, z, and n are each greater than or equal to one; wherein a ratio of the first copolymer to the second copolymer is 30:70; and wherein the first coat further comprises from 5% to 15% (w/w) of a mixture of glycerol monostearate, triethyl citrate, and polysorbate 80; (d) a second coat comprising HPMC positioned exterior of the first coat; and (e) a third coat comprising HPMC positioned interior of the first coat and exterior of the therapeutic payload and the one or more pharmaceutically acceptable excipients.

Described herein, in certain embodiments, are methods of treating an inflammatory disorder in an individual, the method comprising administering to the individual an oral formulation comprising IL-10 and one or more pharmaceutically acceptable excipients to the individual, wherein the administering results in an immunomodulatory response selected from the group consisting of: (i) a decrease in a concentration of fecal calprotectin (FCP) relative to an FCP baseline, (ii) a decrease in a concentration of C-Reactive Protein (CRP) relative to a CRP baseline, (iii) a decrease in a Geboes score relative to a baseline Geboes score, and (iv) a combination of (i)-(iii). In some embodiments, the inflammatory disorder is selected from the group consisting of ulcerative colitis, inflammatory bowel disease (IBD), proctitis, pouchitis, Crohn's disease, Celiac disease, multiple sclerosis (MS), systemic lupus erythematosus (SLE), graft versus host disease (GVHD), rheumatoid arthritis, psoriatic arthritis, or psoriasis.

Described herein, in certain embodiments, are methods of modulating a biomarker in an individual with an inflammatory disorder, the method comprising administering to the individual an oral formulation comprising IL-10 and one or more pharmaceutically acceptable excipients to the individual, wherein the biomarker is selected from the group consisting of fecal calprotectin (FCP), C-Reactive Protein (CRP), and a combination thereof. In some embodiments, the administering results in a decrease in a concentration of the FCP relative to an FCP baseline. In some embodiments, the administering results in a decrease in a concentration of the CRP relative to a CRP baseline. In some embodiments, the administering further results in a decrease in a Geboes score relative to a baseline Geboes score. In some embodiments, comprising treating the individual with the inflammatory disorder. In some embodiments, the inflammatory disorder is selected from the group consisting of ulcerative colitis, inflammatory bowel disease (IBD), proctitis, pouchitis, Crohn's disease, Celiac disease, multiple sclerosis (MS), systemic lupus erythematosus (SLE), graft versus host disease (GVHD), rheumatoid arthritis, psoriatic arthritis, or psoriasis.

Described herein, in certain embodiments, are methods of treating an inflammatory disorder in an individual refractory or resistant to at least one anti-inflammatory agent, the method comprising administering a formulation comprising IL-10 to the individual. In some embodiments, the anti-inflammatory agent is an aminosalicylate. In some embodiments, the aminosalicylate is selected from the group consisting of 5-aminosalicylic acid (5-ASA; mesalazine), 4-amino salacylic acid (4-ASA), balsalazide, olsalazine, and sulfasalazine. In some embodiments, the anti-inflammatory agent is a corticosteroid. In some embodiments, the corticosteroid is prednisone. In some embodiments, the corticosteroid is an orally administered corticosteroid or an intravenously (IV) administered corticosteroid. In some embodiments, the anti-inflammatory agent is an immunosuppressive agent. In some embodiments, the immunosuppressive agent is selected from the group consisting of azathioprine, 6-mercaptopurine, and a combination thereof. In some embodiments, the anti-inflammatory agent is a TNFα inhibitor. In some embodiments, the TNFα inhibitor is selected from the group consisting of adalimumab, certolizumab, etanercept, golimumab, and infliximab.

In some embodiments, the at least one anti-inflammatory agent is a Janus kinase (JAK) inhibitor. In some embodiments, the JAK inhibitor is selected from the group consisting of filgotinib, upadacitinib, peficitinib, and tofacitinib. In some embodiments, the at least one anti-inflammatory agent is a sphingosine-1-phosphate (SIP) receptor antagonist. In some embodiments, the SIP receptor antagonist is selected from the group consisting of ozanimod, amiselimod, and etrasimod. In some embodiments, the at least one anti-inflammatory agent is an integrin blocker. In some embodiments, the integrin blocker is selected from the group consisting of etrolizumab, natalizumab, vedolizumab, abrilumab, and carotegrast methyl. In some embodiments, the at least one anti-inflammatory agent is an IL-23 inhibitor. In some embodiments, the IL-23 inhibitor is selected from the group consisting of ustekinumab. mirikizumab, brazikumab, guselkumab, and risankizumab. In some embodiments, the at least one anti-inflammatory agent is a phosphodiesterase 4 (PDE4) inhibitor. In some embodiments, the at least one PDE4 inhibitor is selected from the group consisting of apremilast, cilomilast, roflumilast, tetomilast, and rolipram. In some embodiments, the at least one anti-inflammatory agent is laquinimod.

Described herein, in certain embodiments, are methods of refolding an IL-10 delivery construct, the method comprising: (i) contacting inclusion bodies comprising the IL-10 delivery construct with a solubilization solution comprising a chaotropic agent to produce a soluble IL-10 delivery construct; (ii) contacting the soluble IL-10 delivery construct with a sulfitolysis reducing agent to produce a reduced IL-10 delivery construct; and (iii) contacting the reduced IL-10 delivery construct with a refolding solution comprising reduced glutathione and oxidized glutathione to produce a refolded IL-10 delivery construct. Described herein, in certain embodiments, are methods of refolding an IL-10 delivery construct, the method comprising: (i) contacting a soluble IL-10 delivery construct with a sulfitolysis reducing agent comprising sodium sulfite to produce a reduced IL-10 delivery construct; (ii) contacting the reduced IL-10 delivery construct with potassium tetrathionate; (iii) clarifying the reduced IL-10 delivery construct by depth filtration to produce a clarified IL-10 delivery construct; (iv) performing ultrafiltration followed by diafiltration on the clarified IL-10 delivery construct; and (v) contacting the clarified IL-10 delivery construct with a refolding solution comprising: from 0.8 mM to 1.2 mM of reduced glutathione, from 0.4 mM to 0.6 mM of oxidized glutathione, from 800 mM to 1.2M arginine, from 200 mM to 300 mM sucrose, from 75 mM to 125 mM Tris, and from 1.5 mM to 2.5 mM EDTA, wherein the refolding solution is buffered at a pH from 7.5 to 8.5 to produce a refolded IL-10 delivery construct, and wherein the contacting with the refolding solution occurs for at least 16 hours. In some embodiments, the sulfitolysis reducing agent comprises sodium sulfite.

Described herein, in certain embodiments, are oral formulations comprising IL-10 and one or more pharmaceutically acceptable excipients, wherein administration of a dose of the oral formulation from about 1 mg to about 60 mg to an individual results in a greater than 20% increase in a plasma concentration of IL-1Ra in the individual relative to a baseline plasma concentration of IL-1Ra. Described herein, in certain embodiments, are methods of treating an inflammatory disorder in an individual comprising administering a dose of an oral formulation comprising IL-10 and one or more pharmaceutically acceptable excipients to the individual, wherein the administering results in a greater than 20% increase in a plasma concentration of IL-1Ra in the individual relative to a baseline plasma concentration of IL-1Ra. In some embodiments, the dose of the oral formulation is from about 3 mg to about 30 mg and the increase in the plasma concentration of IL-1Ra relative to the baseline plasma concentration of IL-1Ra is greater than 30%. In some embodiments, the dose of the oral formulation is from about 3 mg to about 30 mg and the increase in the plasma concentration of IL-1Ra relative to the baseline plasma concentration of IL-1Ra is from 30% to 45%, 30% to 35%, or from 40% to 43%. In some embodiments, administration of the dose of the oral formulation to the individual results in a plasma concentration of IL-10 in the individual that does not exceed 1500 pg/mL, 1000 pg/mL, 500 pg/mL, 100 pg/mL, or 10 pg/mL. In some embodiments, administration of the oral formulation to the individual results in co-localization of the IL-10 with a cell expressing CD3 in a lamina propria of the individual. In some embodiments, the cell expressing CD3 is a lymphocyte. In some embodiments, the lymphocyte is a T lymphocyte. In some embodiments, administration of the oral formulation to the individual results in co-localization of the IL-10 with a macrophage in the lamina propria of the individual. In some embodiments, administration of the oral formulation to the individual does not result in co-localization of the IL-10 with a cell in the lamina propria of the individual, wherein the cell is selected from the group consisting of a dendritic cell, a B-lymphocyte, an endothelial cell, and a combination thereof.

Described herein, in certain embodiments, are oral formulations comprising IL-10 and one or more pharmaceutically acceptable excipients, wherein administration of the oral formulation to an individual results in an increase in a concentration of IL-1Ra in plasma of the individual of at least 5000 pg/mL relative to baseline levels and at least one of the following: (1) a peak IL-10 plasma concentration of less than 50 pg/mL and (2) co-localization of the IL-10 with a cell expressing CD3 in a lamina propria of the individual. Described herein, in certain embodiments, are methods of treating an inflammatory disorder in an individual comprising administering an oral formulation comprising IL-10 and one or more pharmaceutically acceptable excipients to the individual, wherein the administering results in an increase in a concentration of IL-1Ra in plasma of the individual of at least 5000 pg/mL relative to baseline levels and at least one of the following (1) a peak IL-10 plasma concentration of less than 50 pg/mL and (2) co-localization of the IL-10 with a cell expressing CD3 in a lamina propria of the individual. In some embodiments, the inflammatory disorder is selected from the group consisting of ulcerative colitis, proctitis, pouchitis, Crohn's disease, multiple sclerosis (MS), systemic lupus erythematosus (SLE), graft versus host disease (GVHD), rheumatoid arthritis, or psoriasis. In some embodiments, the peak IL-1Ra concentration in plasma of the individual is obtained from 2 to 4 hours, or from 2 to 3 hours, after the administration. In some embodiments, administration of the oral formulation to the individual results in a peak IL-10 concentration in plasma of the individual of less than 10 pg/mL, 2.5 pg/mL, or 1.5 pg/mL. In some embodiments, the concentration of IL-1Ra reaches a maximum of from 25,000 pg/mL to 28,000 pg/mL. In some embodiments, administration of the oral formulation to an individual results in an increase in a ratio of expression of IL-Ra to interleukin 1 beta in the colonic tissue of the individual. In some embodiments, the ratio of IL-1Ra to IL-1 beta is at least 2:1. In some embodiments, administration of the oral formulation to an individual results in an increase in expression of interleukin 1 receptor agonist (IL-1Ra) in a colonic tissue of the individual.

Described herein, in certain embodiments, are non-natural nucleic acids comprising a sequence that has at least 90%, at least 92%, at least 95%, at least 98%, or at least 99% sequence identity to SEQ ID NO: 10. In some embodiments, the non-natural nucleic acid has a sequence with 100% identity to SEQ ID NO: 10.

Described herein, in certain embodiments, are solid oral formulations comprising (i) an IL-10 delivery construct comprising IL-10 coupled to a carrier that promotes transcytosis of the IL-10 delivery construct across a polarized gut epithelial cell; (ii) one or more excipients, wherein the one or more excipients comprise a non-ionic lubricant; and (iii) a first coat surrounding the IL-10 delivery construct and the one or more excipients. In some embodiments, the non-ionic lubricant is glyceryl behenate. In some embodiments, the oral formulation lacks an ionic surfactant. In some embodiments, the oral formulation lacks magnesium stearate. In some embodiments, the oral formulation is in a tablet form.

In some embodiments, the oral formulation is configured such that substantially none of the IL-10 delivery construct is released from the oral formulation after 1 h exposure to a solution at pH 1.0 in a Type 4 dissolution apparatus in open mode. In some embodiments, the oral formulation is configured to release at least 40% of the IL-10 delivery construct after 2 hours of exposure to a solution at pH 7.0 in a Type 4 dissolution apparatus in open mode. In some embodiments, the first coat comprises a blend of polymers each having a different nominal dissolution pH. In some embodiments, at least 45% of the IL-10 delivery construct is in a dimer form.

In some embodiments, the one or more excipients comprise a bulking agent, a disintegrant, or a combination thereof. In some embodiments, the bulking agent is silicified microcrystalline cellulose (SMCC). In some embodiments, the disintegrant is crospovidone (crosslinked polyvinylpyrrolidone). In some embodiments, the IL-10 delivery construct has at least 80%, 85%, 90%, 92%, 94%, 95%, 96%, 97%, 98%, 99%, or 100% sequence identity to an amino acid sequence set forth in SEQ ID NO: 5. In some embodiments, the IL-10 delivery construct has at least 80%, 85%, 90%, 92%, 94%, 95%, 96%, 97%, 98%, 99%, or 100% sequence identity to an amino acid sequence set forth in SEQ ID NO: 13.

Described herein, in certain embodiments, are oral formulations in tablet form comprising IL-10 and one or more pharmaceutically acceptable excipients encapsulated by an enteric coating, wherein, following 1 hr of submersion of the oral formulation into a solution at pH 7.0 in a Type 4 dissolution apparatus, a percentage of IL-10 in dimer form is at least 45%. In some embodiments, the solution at pH 7.0 is a citrate/phosphate buffer. In some embodiments, the enteric coating has a thickness of from 4 $mg/cm^2$ to 20 $mg/cm^2$, from 4 $mg/cm^2$ to 6 $mg/cm^2$, from 5 $mg/cm^2$ to 10 $mg/cm^2$, or from 5 $mg/cm^2$ to 20 $mg/cm^2$. In some embodiments, the IL-10 comprises at least 80%, 85%, 90%, 92%, 94%, 95%, 96%, 97%, 98%, 99%, or 100% sequence identity to an amino acid sequence set forth in SEQ ID NO: 2.

In some embodiments, the one or more pharmaceutically acceptable excipients comprise a surfactant. In some embodiments, the surfactant is poloxamer 188. In some embodiments, the one or more pharmaceutically acceptable excipients comprise an osmolyte. In some embodiments, the osmolyte is sucrose. In some embodiments, the one or more pharmaceutically acceptable excipients comprise a salt. In some embodiments, the salt is potassium phosphate. In some embodiments, the one or more pharmaceutically acceptable excipients comprise a bulking agent. In some embodiments, the bulking agent is glycine. In some embodiments, the one or more pharmaceutically acceptable excipients comprises at least one compacting excipient. In some embodiments, the at least one compacting excipient comprises a bulking agent. In some embodiments, the bulking agent is silicified microcrystalline cellulose (SMCC). In some embodiments, the at least one compacting excipient comprises a disintegrant. In some embodiments, the disintegrant is crospovidone (crosslinked polyvinylpyrrolidone). In some embodiments, the at least one compacting excipient comprises a lubricant. In some embodiments, the lubricant is a non-ionic surfactant. In some embodiments, the non-ionic surfactant is glyceryl behenate. In some embodiments, the non-ionic surfactant is glyceryl dibehenate. In some embodiments, the at least one compacting excipient is comprised in an intragranular phase, an extragranular phase, or a combination thereof.

In some embodiments, the oral formulation is created by compression of the IL-10 and the at least one compacting excipients. In some embodiments, the compression occurs with a compression force of from about 2000 pound-force (lbf) to about 3500 lbf.

In some embodiments, the IL-10 is part of an IL-10 delivery construct having at least 80%, 85%, 90%, 92%, 94%, 95%, 96%, 97%, 98%, 99%, or 100% sequence identity to an amino acid sequence set forth in SEQ ID NO: 5. In some embodiments, the IL-10 is part of an IL-10 delivery construct having at least 80%, 85%, 90%, 92%, 94%, 95%, 96%, 97%, 98%, 99%, or 100% sequence identity to an amino acid sequence set forth in SEQ ID NO: 13.

In some embodiments, the enteric coating comprises a first copolymer and a second copolymer, wherein the enteric coating is external of the IL-10 and one or more pharmaceutically acceptable excipients. In some embodiments, the first copolymer comprises methacrylic acid and ethyl acrylate. In some embodiments, the second copolymer comprises methacrylic acid, methyl methacrylate, and methyl acrylate. In some embodiments, a ratio of the first copolymer to the second copolymer in the enteric coating is from about 50:50 to about 20:80 by weight. In some embodiments, the ratio of the first copolymer to the second copolymer in the enteric coating is from about 25:75 to about 35:65 by weight. In some embodiments, the enteric coating is from 5% to 12% of the weight of the oral formulation. In some embodiments, the enteric coating is no more than 12% of the weight of the oral formulation. In some embodiments, the oral formulation further comprises a second enteric coating located interior of the enteric coating and external of the IL-10 and one or more pharmaceutically acceptable excipients. In some embodiments, the second enteric coating comprises hydroxypropyl methylcellulose (HPMC). In some embodiments, the second enteric is from 3% to 5% of the weight of the oral formulation. In some embodiments, the percentage of IL-10 in dimer form is at least 45% when the oral formulation is in a solid form.

In some embodiments, the enteric coating comprises hydroxypropyl methylcellulose acetate succinate (HPMCAS), wherein the enteric coating is external of the IL-10 and one or more pharmaceutically acceptable excipients. In some embodiments, the HPMCAS comprises a first HPMCAS and a second HPMCAS. In some embodiments, the first HPMCAS is soluble at a pH of greater than or equal to 6.8. In some embodiments, the first HPMCAS comprises HPMCAS-HF. In some embodiments, the second HPMCAS is soluble at a pH of greater than or equal to 6.0. In some embodiments, the second HPMCAS comprises HPMCAS-MF. In some embodiments, a ratio of the first HPMCAS to the second HPMCAS is from about 40:60 to about 60:40.

Disclosed herein, in certain embodiments, are methods comprising administering any of the formulations described herein for treatment of a disease or condition in an individual in need thereof. Similarly, disclosed herein are the IL-10 delivery constructs or formulations described herein for use in treating a disease or condition in an individual in need thereof. Similarly, disclosed herein is the use of an IL-10 delivery construct as disclosed herein in the manufacture of a medicament for treating a disease or condition in an individual in need thereof. In some embodiments, the disease or condition is selected from the group consisting of ulcerative colitis, inflammatory bowel disease (IBD), Celiac disease, proctitis, pouchitis, Crohn's disease, multiple sclerosis (MS), systemic lupus erythematosus (SLE), graft versus host disease (GVHD), rheumatoid arthritis, psoriatic arthritis, and psoriasis.

Disclosed herein, in certain embodiments, are solid compositions comprising: IL-10 delivery constructs; and one or more excipients; wherein each of the IL-10 delivery constructs comprises IL-10 coupled to a carrier that promotes transcytosis of the IL-10 delivery construct across a polarized gut epithelial cell; and wherein greater than 80% of the IL-10 delivery constructs are in a dimer form. In some embodiments, the carrier comprises an amino acid sequence set forth in SEQ ID NO: 4. In some embodiments, the carrier comprises an amino acid sequence set forth in SEQ ID NO: 12. In some embodiments, the carrier comprises an amino acid sequence comprising positions 1-386 of any one of SEQ ID NOS: 20-146. In some embodiments, the carrier comprises an amino acid sequence comprising positions 1-386 of SEQ ID NO: 147.

In some embodiments, the solid composition is a tablet or a capsule. In some embodiments, the one or more excipients comprise poloxamer 188, sucrose, potassium phosphate, glycine, or a combination thereof. In some embodiments, the IL-10 comprises at least 80%, 85%, 90%, 92%, 94%, 95%, 96%, 97%, 98%, 99%, or 100% sequence identity to an amino acid sequence set forth in SEQ ID NO: 2. In some embodiments, the IL-10 is coupled to the carrier via a linker. In some embodiments, the linker comprises an amino acid sequence set forth in SEQ ID NO: 6. In some embodiments, greater than 81%, 82%, 83%, 84%, 85%, 86%, 87%, 88%, 89%, or 90% of the IL-10 delivery constructs are in a dimer form. In some embodiments, from 85% to 92% of the IL-10 delivery constructs are in a dimer form.

In some embodiments, the solid composition comprises an enteric coating. In some embodiments, the enteric coating comprises a first copolymer and a second copolymer, wherein the enteric coating is external of the IL-10 delivery construct and one or more excipients. In some embodiments, the first copolymer comprises methacrylic acid and ethyl acrylate. In some embodiments, the second copolymer comprises methacrylic acid, methyl methacrylate, and methyl acrylate. In some embodiments, a ratio of the first copolymer to the second copolymer in the enteric coating is from about 50:50 to about 20:80. In some embodiments, a ratio of the first copolymer to the second copolymer in the enteric coating is from about 25:75 to about 35:65.

Disclosed herein, in certain embodiments, are methods of refolding an IL-10 delivery construct, the method comprising: (i) contacting inclusion bodies comprising the IL-10 delivery construct with a solubilization solution comprising a chaotropic agent to produce a soluble IL-10 delivery construct; (ii) contacting the soluble IL-10 delivery construct with a refolding solution comprising reduced glutathione and oxidized glutathione to produce a refolded IL-10 delivery construct; wherein the method does not comprise contacting the soluble IL-10 delivery construct with a sulfitolysis agent or a reducing agent prior to the contacting of step (ii). In some embodiments, the IL-10 delivery construct comprises IL-10 coupled to a carrier. In some embodiments, the carrier comprises an amino acid sequence set forth in SEQ ID NO: 4. In some embodiments, the carrier comprises an amino acid sequence set forth in SEQ ID NO: 12. In some embodiments, the carrier comprises an amino acid sequence comprising positions 1-386 of any one of SEQ ID NOS: 20-146. In some embodiments, the carrier comprises an amino acid sequence comprising positions 1-386 of SEQ ID NO: 147.

In some embodiments, the refolding solution comprises a ratio (w/w) of the reduced glutathione to the oxidized glutathione from 0.8:1 to 1.2:1. In some embodiments, the refolding solution comprises from 0.75 mM to 1.5 mM reduced glutathione. In some embodiments, the refolding solution comprises from 0.25 mM to 0.75 mM oxidized glutathione. In some embodiments, the refolding solution comprises a pH from 7.5 to 8.5. In some embodiments, the refolding solution comprises arginine, Tris, and EDTA. In some embodiments, the refolding solution comprises sucrose. In some embodiments, the refolding solution comprises arginine, sucrose, Tris, EDTA, or a combination thereof. In some embodiments, arginine is present in the refolding solution at a concentration of between 900 mM and 1.1 M. In some embodiments, sucrose is present in the refolding solution at a concentration of between 200 mM and 300 mM. In some embodiments, Tris is present in the refolding solution at a concentration of from 75 mM to 125 mM. In some embodiments, EDTA is present in the refolding solution at a concentration of from 1.75 mM to 2.25 mM.

In some embodiments, the method further comprises lysing a cell comprising the inclusion bodies. In some embodiments, the cell is a bacterium. In some embodiments, the bacterium is *Escherichia coli*. In some embodiments, the lysing comprises high-pressure homogenization. In some embodiments, the method further comprises isolating the inclusion bodies. In some embodiments, the chaotropic agent comprises guanidine hydrochloride or urea. In some embodiments, the solubilization solution further comprises Tris.

In some embodiments, the contacting the soluble IL-10 delivery construct with a refolding solution occurs for at least 16 hours. In some embodiments, the contacting the soluble IL-10 delivery construct with a refolding solution occurs from 12 hours to 18 hours. In some embodiments, the contacting the IL-10 delivery construct with a refolding solution occurs from 2° C. to 8° C. In some embodiments, the method further comprises a first sterile filtration of the refolded IL-10 delivery construct. In some embodiments, the first sterile filtration occurs after the contacting with the refolding solution. In some embodiments, the method further comprises performing a tangential flow filtration of the refolded IL-10 delivery construct. In some embodiments, the tangential flow filtration comprises diafiltration. In some embodiments, the diafiltration comprises a first diavolume, a second diavolume, a third diavolume, and a fourth diavolume. In some embodiments, the first diavolume and the second diavolume comprise a cold buffer. In some embodiments, the third diavolume and the fourth diavolume comprise a room temperature buffer. In some embodiments, the cold buffer and the room temperature buffer comprise Tris and NaCl.

In some embodiments, IL-10 delivery construct dimers may be stored in buffer, for example at 25° C. for two days. Such a buffer may comprise a salt such as 1×PBS, 150 mM, or 200 mM NaCl buffered in 10 mM Sodium Phosphate at pH 7.0. IL-10 delivery construct dimers may be more stable when stored in a buffer comprising a salt such as 1×PBS, 150 mM, or 200 mM NaCl buffered in 10 mM Sodium Phosphate at pH 7.0 than in a buffer comprising 10 mM Sodium Phosphate at pH 7.0 alone.

Described herein, in certain embodiments, are methods of enriching for IL-10 delivery construct dimers from a pool comprising IL-10 delivery constructs in a dimer form, a monomer form, and an aggregate form, the method comprising: (i) performing anion exchange (AEX) chromatography on the pool by binding the IL-10 delivery construct dimers to an anion exchange column and subsequently eluting the IL-10 delivery construct dimers from the anion exchange column, thereby creating a first plurality of fractions, one of which is a first fraction enriched in IL-10 delivery constructs in the dimer form; and (ii) performing ceramic hydroxyapatite (CHT) chromatography on the fraction enriched in IL-10 delivery constructs in the dimer form, thereby creating a second plurality of fractions, one of which is a second fraction further enriched in IL-10 delivery constructs in the dimer form. In some embodiments, each of the IL-10 delivery constructs comprises IL-10 coupled to a carrier. In some embodiments, the carrier comprises an amino acid sequence set forth in SEQ ID NO: 4. In some embodiments, the carrier comprises an amino acid sequence set forth in SEQ ID NO: 12. In some embodiments, the carrier comprises an amino acid sequence comprising positions 1-386 of any one of SEQ ID NOS: 20-146. In some embodiments, the carrier comprises an amino acid sequence comprising positions 1-386 of SEQ ID NO: 147.

In some cases, the method can comprise performing cation exchange chromatography, for example with a Sulfate 650F column. The cation exchange chromatography step may be performed after an anion exchange chromatography step and a ceramic hydroxyapatite (CHT) purification step, before an anion exchange chromatography step and a ceramic hydroxyapatite (CHT) purification step, or between an anion exchange chromatography step and a ceramic hydroxyapatite (CHT) purification step.

In some embodiments, the method further comprises determining the percentage of IL-10 delivery constructs in the dimer form in each fraction of the first plurality of fractions. In some embodiments, the determining is by size exclusion chromatography. In some embodiments, the size exclusion chromatography is size exclusion high performance liquid chromatography (SE-HPLC). In some embodiments, the method further comprises determining the percentage of IL-10 delivery constructs in the dimer form in each fraction of the second plurality of fractions. In some embodiments, the determining is by size exclusion chromatography. In some embodiments, the size exclusion chromatography is size exclusion high performance liquid chromatography (SE-HPLC).

In some embodiments, at least 75% of the IL-10 delivery constructs in the first fraction are IL-10 delivery constructs in the dimer form. In some embodiments, at least 80% of the IL-10 delivery constructs in the second fraction are IL-10 delivery constructs in the dimer form. In some embodiments, the method further comprises performing tangential flow filtration of the second fraction. In some embodiments, the tangential flow filtration comprises ultrafiltration. In some embodiments, the method further comprises diafiltration. In some embodiments, the method further comprises performing sterile filtration the second fraction. In some embodiments, the method does not comprise cation exchange chromatography. In some embodiments, the pool comprises refolded IL-10 delivery constructs obtained from any of the methods described herein.

Described herein, in certain embodiments, are methods of treating an inflammatory disorder in an individual refractory or resistant to at least one anti-inflammatory agent, the method comprising administering a formulation comprising IL-10 to the individual. Similarly, disclosed herein are the IL-10 delivery constructs or formulations described herein for use in treating an inflammatory disorder in an individual refractory or resistant to at least one anti-inflammatory agent. Similarly, disclosed herein are the use of an IL-10 delivery construct as disclosed herein in the manufacture of a medicament for treating an inflammatory disorder in an individual refractory or resistant to at least one anti-inflammatory agent. In some embodiments, the anti-inflammatory agent is an aminosalicylate. In some embodiments, the aminosalicylate is selected from the group consisting of 5-aminosalicylic acid (5-ASA; mesalazine), 4-amino salicylic acid (4-ASA), balsalazide, olsalazine, and sulfasalazine. In some embodiments, the anti-inflammatory agent is a corticosteroid. In some embodiments, the corticosteroid is prednisone. In some embodiments, the corticosteroid is an orally administered corticosteroid or an intravenously (IV) administered corticosteroid. In some embodiments, the anti-inflammatory agent is an immunosuppressive agent. In some embodiments, the immunosuppressive agent is selected from the group consisting of azathioprine, 6-mercaptopurine, and a combination thereof. In some embodiments, the anti-inflammatory agent is a TNFα inhibitor. In some embodiments, the TNFα inhibitor is selected from the group consisting of adalimumab, certolizumab, etanercept, golimumab, and infliximab. In some embodiments, the at least one anti-inflammatory agent is a Janus kinase (JAK) inhibitor. In some embodiments, the JAK inhibitor is selected from the group consisting of filgotinib, upadacitinib, peficitinib, and tofacitinib. In some embodiments, the at least one anti-inflammatory agent is a sphingosine-1-phosphate (SIP) receptor antagonist. In some embodiments, the SIP receptor antagonist is selected from the group consisting of ozanimod, amiselimod, and etrasimod. In some embodiments, the at least one anti-inflammatory agent is an integrin blocker. In some embodiments, the integrin blocker is selected from the group consisting of etrolizumab, natalizumab, vedolizumab, abrilumab, and carotegrast methyl. In some embodiments, the at least one anti-inflammatory agent is an IL-23 inhibitor. In some embodiments, the IL-23 inhibitor is selected from the group consisting of ustekinumab. mirikizumab, brazikumab, guselkumab, and risankizumab. In some embodiments, the at least one anti-inflammatory agent is a phosphodiesterase 4 (PDE4) inhibitor. In some embodiments, the at least one PDE4 inhibitor is selected from the group consisting of apremilast, cilomilast, roflumilast, tetomilast, and rolipram. In some embodiments, the at least one anti-inflammatory agent is laquinimod. In some embodiments, the individual is administered the formulation daily for at least 5, 7, 10, 12, or 14 days.

In some embodiments, the inflammatory disorder is selected from the group consisting of ulcerative colitis, proctitis, pouchitis, Crohn's disease, multiple sclerosis (MS), systemic lupus erythematosus (SLE), graft versus host disease (GVHD), rheumatoid arthritis, or psoriasis. In some embodiments, the IL-10 comprises at least 80%, 85%, 90%, 92%, 94%, 95%, 96%, 97%, 98%, 99%, or 100% sequence identity to an amino acid sequence set forth in SEQ ID NO: 2. In some embodiments, the one or more pharmaceutically acceptable excipients comprise a surfactant. In some embodiments, the surfactant is selected from the group consisting of: polysorbate 80, polysorbate 20, and poloxamer 188. In some embodiments, the one or more pharmaceutically acceptable excipients comprise an osmolyte. In some embodiments, the osmolyte is selected from the group consisting of sucrose and trehalose. In some embodiments, the one or more pharmaceutically acceptable excipients comprise a salt. In some embodiments, the salt is selected from the group consisting of potassium phosphate, sodium chloride, potassium chloride, magnesium chloride, and sodium sulfate. In some embodiments, the one or more pharmaceutically acceptable excipients comprise a bulking agent. In some embodiments, the bulking agent is selected from the group consisting of: glycine and mannitol. In some embodiments, the one or more pharmaceutically acceptable excipients comprise a disintegrant. In some embodiments, the disintegrant is selected from the group consisting of: microcrystalline cellulose (MCC), silicified microcrystalline cellulose (SMCC), starch, sodium starch glycolate, veegum, bentonite, alginic acid, calcium alginate, croscarmellose sodium (crosslinked sodium carboxymethyl cellulose), and crospovidone (crosslinked polyvinylpyrrolidone). In some embodiments, the one or more pharmaceutically acceptable excipients comprise a binding agent. In some embodiments, the binding agent is selected from the group consisting of: sucrose, lactose, starch, cellulose, gelatin, polyvinylpyrrolidone (PVP), and polyethylene glycol (PEG). In some embodiments, the one or more pharmaceutically acceptable excipients comprise a lubricant. In some embodiments, the lubricant is selected from the group consisting of: magnesium stearate, glyceryl behenate, glyceryl dibehenate, sodium stearyl fumerate, stearic acid, talc, silica, calcium stearate, magnesium carbonate, hydrogenated oil, mineral oil, polyethylene glycol (PEG), and glyceryl monostearate.

In some embodiments, the IL-10 is part of an IL-10 delivery construct comprising the IL-10 coupled to a carrier. In some embodiments, the IL-10 delivery construct comprises a linker coupling the IL-10 to the carrier. In some embodiments, the linker comprises an amino acid sequence set forth in SEQ ID NO: 6. In some embodiments, the carrier has at least 80%, 85%, 90%, 92%, 94%, 95%, 96%, 97%, 98%, 99%, or 100% sequence identity to an amino acid sequence set forth in SEQ ID NO: 4. In some embodiments, the IL-10 delivery construct has at least 80%, 85%, 90%, 92%, 94%, 95%, 96%, 97%, 98%, 99%, or 100% sequence identity to an amino acid sequence set forth in SEQ ID NO: 5. In some embodiments, upon contact with a cell, the carrier promotes endocytosis or transcytosis of the IL-10 delivery construct. In some embodiments, the cell is a gut epithelial cell. In some embodiments, the gut epithelial cell is a polarized gut epithelial cell.

In some embodiments, the formulation is an oral formulation. In some embodiments, the oral formulation is a capsule or a tablet. In some embodiments, the oral formulation comprises a first coating comprising a first copolymer and a second copolymer, wherein the first coating is external of the IL-10 and one or more pharmaceutically acceptable excipients. In some embodiments, the first copolymer comprises methacrylic acid and ethyl acrylate. In some embodiments, the second copolymer comprises methacrylic acid, methyl methacrylate, and methyl acrylate. In some embodiments, a ratio (w/w) of the first copolymer to the second copolymer in the first coat is from 0.8:1 to 1.2:1. In some embodiments, the administering comprises oral administration.

Disclosed herein, in certain embodiments, are methods of preventing a recurrence of an inflammatory disorder in an individual in remission for the inflammatory disorder comprising administering a formulation comprising IL-10 and one or more pharmaceutically acceptable excipients to the individual. In some embodiments, the inflammatory disorder is selected from the group consisting of ulcerative colitis, proctitis, pouchitis, Crohn's disease, multiple sclerosis (MS), systemic lupus erythematosus (SLE), graft versus host disease (GVHD), rheumatoid arthritis, or psoriasis.

In some embodiments, the IL-10 comprises at least 80%, 85%, 90%, 92%, 94%, 95%, 96%, 97%, 98%, 99%, or 100% sequence identity to an amino acid sequence set forth in SEQ ID NO: 2. In some embodiments, the one or more pharmaceutically acceptable excipients comprise a surfactant. In some embodiments, the surfactant is selected from the group consisting of: polysorbate 80, polysorbate 20, and poloxamer 188. In some embodiments, the one or more pharmaceutically acceptable excipients comprise an osmolyte. In some embodiments, the osmolyte is selected from the group consisting of sucrose and trehalose. In some embodiments, the one or more pharmaceutically acceptable excipients comprise a salt. In some embodiments, the salt is selected from the group consisting of potassium phosphate, sodium chloride, potassium chloride, magnesium chloride, and sodium sulfate. In some embodiments, the one or more pharmaceutically acceptable excipients comprise a bulking agent. In some embodiments, the bulking agent is selected from the group consisting of: glycine and mannitol. In some embodiments, the one or more pharmaceutically acceptable excipients comprise a disintegrant. In some embodiments, the disintegrant is selected from the group consisting of: microcrystalline cellulose (MCC), silicified microcrystalline cellulose (SMCC), starch, sodium starch glycolate, veegum, bentonite, alginic acid, calcium alginate, croscarmellose sodium (crosslinked sodium carboxymethyl cellulose), and crospovidone (crosslinked polyvinylpyrrolidone). In some embodiments, the one or more pharmaceutically acceptable excipients comprise a binding agent. In some embodiments, the binding agent is selected from the group consisting of: sucrose, lactose, starch, cellulose, gelatin, polyvinylpyrrolidone (PVP), and polyethylene glycol (PEG). In some embodiments, the one or more pharmaceutically acceptable excipients comprise a lubricant. In some embodiments, the lubricant is selected from the group consisting of: magnesium stearate, glyceryl behenate, glyceryl dibehenate, sodium stearyl fumerate, stearic acid, talc, silica, calcium stearate, magnesium carbonate, hydrogenated oil, mineral oil, polyethylene glycol (PEG), and glyceryl monostearate.

In some embodiments, the IL-10 is part of an IL-10 delivery construct comprising the IL-10 coupled to a carrier. In some embodiments, the IL-10 delivery construct comprises a linker coupling the IL-10 to the carrier. In some embodiments, the linker comprises an amino acid sequence set forth in SEQ ID NO: 6. In some embodiments, the carrier has at least 80%, 85%, 90%, 92%, 94%, 95%, 96%, 97%, 98%, 99%, or 100% sequence identity to an amino acid sequence set forth in SEQ ID NO: 4. In some embodiments, the IL-10 delivery construct has at least 80%, 85%, 90%, 92%, 94%, 95%, 96%, 97%, 98%, 99%, or 100% sequence identity to an amino acid sequence set forth in SEQ ID NO: 5. In some embodiments, upon contact with a cell, the carrier promotes endocytosis or transcytosis of the IL-10 delivery construct. In some embodiments, the cell is a gut epithelial cell. In some embodiments, the gut epithelial cell is a polarized gut epithelial cell.

In some embodiments, the formulation is an oral formulation. In some embodiments, the oral formulation is a capsule or a tablet. In some embodiments, the oral formulation comprises a first coating comprising a first copolymer and a second copolymer, wherein the first coating is external of the IL-10 and one or more pharmaceutically acceptable excipients. In some embodiments, the first copolymer comprises methacrylic acid and ethyl acrylate. In some embodiments, the second copolymer comprises methacrylic acid, methyl methacrylate, and methyl acrylate. In some embodiments, a ratio of the first copolymer to the second copolymer in the first coat is from 0.8:1 to 1.2:1. In some embodiments, the administering comprises oral administration.

In some embodiments the present disclosure provides a method of treating an inflammatory disease in a subject in need thereof, the method comprising orally administering an IL-10 therapeutic to the subject and administering a non-IL-10 immunosuppressor to the subject. In other embodiments the present disclosure provides a method of treating an inflammatory disease in a subject in need thereof, the method comprising orally administering an IL-10 therapeutic to the subject, wherein the subject concomitantly receives a non-IL-10 immunosuppressor. In further embodiments the present disclosure provides a method of treating an inflammatory disease in a subject, wherein the subject had an inadequate response to anon-IL-10 immunosuppressor, the method comprising orally administering an IL-10 therapeutic to the subject.

In some cases, the method further comprises administering the non-IL-10 immunosuppressor with the IL-10 therapeutic. In some cases, the subject was treated with the non-IL-10 immunosuppressor for at least 6 weeks prior to determining the inadequate response. In some cases, the subject was treated with the non-IL-10 immunosuppressor for at least 12 weeks prior to determining the inadequate response. In some cases, the inadequate response is a partial response.

In some cases, the inflammatory disease is selected from the group consisting of: inflammatory bowel disease, psoriasis, plaque psoriasis, hidradenitis suppurativa, psoriatic arthritis, rheumatoid arthritis, juvenile idiopathic arthritis, ankylosing spondylitis, bacterial sepsis, Crohn's disease, fistulizing Crohn's disease, moderate-to-severe ulcerative colitis, mild-to-moderate ulcerative colitis, ulcerative colitis, collagenous colitis, lymphocytic colitis, ischaemic colitis, diversion colitis, Behcet's syndrome, indeterminate colitis, pancreatitis, liver inflammation, pouchitis, proctitis, uveitis, graft vs host disease, and epithelial cell injury. In some cases, the inflammatory disease is an inflammatory bowel disease. In some cases, the inflammatory disease is selected from the group consisting of: rheumatoid arthritis, ulcerative colitis, and Crohn's disease.

In some cases, the inflammatory disease is rheumatoid arthritis and the subject with an inadequate response has one or more joints with active disease. In some cases, the one or more joints with active disease are identified by fluorescent optical imaging or magnetic resonance imaging. In some cases, the subject with an inadequate response additionally has two or more joints which are tender. In some cases, the subject with an inadequate response additionally has two or more joints which are swollen.

In some cases, the inflammatory disease is ulcerative colitis, and the subject with an inadequate response has moderate to severe ulcerative colitis. In some cases, the subject with an inadequate response has a modified Mayo Clinic Score (MMS) of between about 4 points and about 9 points. In some cases, the subject with an inadequate response has a centrally read MCS endoscopic sub score of grade 2 or higher. In some cases, the subject with an inadequate response has a MMS rectal bleeding sub score of 1 point or higher. In some cases, the subject with an inadequate response has disease extending 15 cm or more from the anal verge. The method of any one of the above claims, wherein the IL-10 therapeutic is an IL-10 delivery construct.

In some cases, the IL-10 delivery construct comprises a carrier consisting of an amino acid sequence set forth in SEQ ID NO: 4. In some cases, the IL-10 delivery construct comprises a carrier consisting of an amino acid sequence at least 90% identical to SEQ ID NO: 4. In some cases, the IL-10 delivery construct comprises an amino acid sequence set forth in SEQ ID NO: 5.

In some cases, the non-IL-10 immunosuppressor is a TNF alpha inhibitor. In some cases, the TNF alpha inhibitor is a monoclonal antibody. In some cases, the TNF alpha inhibitor is selected from the group consisting of infliximab (Remicade), adalimumab (Humira) and golimumab (Simponi). In some cases, the TNF alpha inhibitor comprises SEQ ID NO: 151 and SEQ ID NO: 152. In some cases, the TNF alpha inhibitor comprises SEQ ID NO: 153 and SEQ ID NO: 154. In some cases, the TNF alpha inhibitor is not etanercept.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The patent or application file contains at least one drawing executed in color. Copies of this patent or patent application publication with color drawing(s) will be provided by the Office upon request and payment of the necessary fee. Various features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

FIG. 2A illustrates an exemplary process for expressing, refolding, and purifying IL-10 or IL-10 delivery constructs with a sulfitolysis step. FIG. 2B illustrates an exemplary process for expressing, refolding, and purifying IL-10 or IL-10 delivery constructs without a sulfitolysis step.

FIG. 5A illustrates release of caffeine from a capsule of formulation A. Differences in samples as compared to their preceding sample are indicated with an asterisk (*), which represents a statistically significant change ($p<0.05$). The visual scores of the capsules are indicated above the bars (1: capsule intact; 2: capsule damaged but almost all product is still in the capsule; 3: capsule damaged and all product is released; 4: capsule destroyed). FIG. 5B illustrates release of caffeine from a capsule of formulation B. FIG. 5C release of caffeine from a capsule of formulation C. FIG. 5D illustrates release of caffeine from a capsule of formulation D. FIG. 5E illustrates release of caffeine from a capsule of formulation E.

FIG. 6A illustrates percent caffeine release from capsule coatings A-B. FIG. 6B illustrates percent caffeine release from capsule coatings C-F. FIG. 6C illustrates percent caffeine release from capsule coatings G-H. Capsule coatings A-H are described in TABLE 23.

FIG. 7A illustrates percent caffeine release from capsule coatings A-B. FIG. 7B illustrates percent caffeine release from capsule coatings C-F. FIG. 7C illustrates percent caffeine release from capsule coatings G-H. Capsule coatings A-H are described in TABLE 23.

FIG. 8A illustrates percent caffeine release from capsule coatings A-B. FIG. 8B illustrates percent caffeine release from capsule coatings C-F. FIG. 8C illustrates percent caffeine release from capsule coatings G-H. Capsule coatings A-H are described in TABLE 23.

FIG. 9A illustrates percent target construct release from capsule coatings A-B. FIG. 9B illustrates percent target construct release from capsule coatings C-F. FIG. 9C illustrates percent target construct release from capsule coatings G-H. Capsule coatings A-H are described in TABLE 23.

FIG. 10A illustrates percent target construct release from capsule coatings A-B. FIG. 10B illustrates percent target construct release from capsule coatings C-F. FIG. 10C illustrates percent target construct release from capsule coatings G-H. Capsule coatings A-H are described in TABLE 23.

FIG. 11A illustrates percent target construct release from capsule coatings A-B. FIG. 11B illustrates percent target construct release from capsule coatings C-F. FIG. 11C illustrates percent target construct release from capsule coatings G-H. Capsule coatings A-H are described in TABLE 23.

FIG. 12A illustrates percent released target constructs in the dimer form from capsule coatings A-B. FIG. 12B illustrates percent released target constructs in the dimer form from capsule coatings C-F. FIG. 12C illustrates percent released target constructs in the dimer form from capsule coatings G-H. Capsule coatings A-H are described in TABLE 23.

FIG. 13A illustrates percent released target constructs in the dimer form from capsule coatings A-B. FIG. 13B illustrates percent released target constructs in the dimer form from capsule coatings C-F. FIG. 13C illustrates percent released target constructs in the dimer form from capsule coatings G-H. Capsule coatings A-H are described in TABLE 23.

FIG. 14A illustrates percent released target constructs in the dimer form from capsule coatings A-B. FIG. 14B illustrates percent released target constructs in the dimer form from capsule coatings C-F. FIG. 14C illustrates percent released target constructs in the dimer form from capsule coatings G-H. Capsule coatings A-H are described in TABLE 23.

FIG. 15A illustrates serum levels of IL-10.

FIG. 15B illustrates serum levels of caffeine. FIG. 15C illustrates serum levels of IL-IRA. X and Y axes are a log scale. Mean for each group is plotted with bars representing standard error of the mean.

FIG. 16A illustrates serum levels of IL-10. FIG. 16B illustrates serum levels of caffeine. FIG. 16C illustrates serum levels of IL-IRA. X and Y axes are a log scale. Mean for each group is plotted with bars representing standard error of the mean.

FIG. 17A illustrates serum levels of IL-10. FIG. 17B illustrates serum levels of caffeine. FIG. 17C illustrates serum levels of IL-IRA. X and Y axes are a log scale. Mean for each group is plotted with bars representing standard error of the mean.

FIG. 20A illustrates total recovery of the target construct, recovery of the dimer, and dimer percentage following dissolution of an F1 tablet created using a compression force of 2000 pound-force (lbf). FIG. 20B illustrates total recovery of the target construct, recovery of the dimer, and dimer percentage following dissolution of an F1 tablet created using a compression force 2500 lbf. FIG. 20C illustrates total recovery of the target construct, recovery of the dimer, and dimer percentage following dissolution of an F2 tablet created using a compression force of 2500 lbf. FIG. 20D illustrates total recovery of the target construct, recovery of the dimer, and dimer percentage following dissolution of an F2 tablet created using a compression force of 3000 lbf. In these experiments, dimer recovery indicated the absolute amount of dimer identified relative to a reference standard. In these experiments, dimer purity indicated the percent of dimer relative to all forms of the IL-10 delivery construct detected (which included aggregates and monomers). Analysis was carried out at pH 7.0.

FIG. 23A illustrate the effect of 5 freeze/thaw cycles on the target construct aggregate (HMW) percentage. FIG. 23B illustrate the effect of 5 freeze/thaw cycles on the target constructs dimer percentage.

FIG. 24A illustrates the change in percent of target construct aggregates at 4° C. FIG. 24B illustrates the change in percent of target dimer at 4° C.

FIG. 25A shows a contour plot of refolding efficiency (% of dimer at end of refolding). FIG. 25B shows a bar plot of refolding efficiencies.

FIG. 26A shows a contour plot of refolding efficiency. FIG. 26B shows a bar plot of refolding efficiencies.

FIG. 27A shows a contour plot of refolding efficiency. FIG. 27B shows a bar plot of refolding efficiencies.

FIG. 31A illustrates an oral formulation 3200 comprising an interior region comprising therapeutic protein (3201), a first coat (3203), a second coat (3202), and a third coat (3204). FIG. 31B illustrates an oral formulation comprising a first coat (3203).

FIG. 32A illustrates time of initial radiolabel release following administration of oral capsule coating formulations in healthy volunteers. FIG. 32B illustrates time of complete radiolabel release following administration of oral capsule coating formulations in healthy volunteers.

FIG. 33A illustrates anatomical location of initial radiolabel release following administration of oral capsule coating formulations in healthy volunteers. FIG. 33B illustrates anatomical location of complete radiolabel release following administration of oral capsule coating formulations in healthy volunteers. PSB=proximal small bowel; DSB=distal small bowel; AC=ascending colon; TC=transverse colon; DC=descending colon.

FIG. 39A illustrates the effect of oral IL-10 delivery construct administration on cellular expression of NFκB. FIG. 39B illustrates the effect of oral IL-10 delivery construct administration on cellular expression of TNFα. FIG. 39C illustrates the effect of oral IL-10 delivery construct administration on cellular expression of CD4. FIG. 39D illustrates the effect of oral IL-10 delivery construct administration on cellular expression of IL-4. FIG. 39E illustrates the effect of oral IL-10 delivery construct administration on cellular expression of Foxp3.

FIG. 40A illustrates a Luminex array of IL-6 following oral delivery of an IL-10 delivery construct dosing solution. FIG. 40B illustrates a Luminex array of IL-23 following oral delivery of an IL-10 delivery construct dosing solution.

FIG. 41A illustrates plasma concentration of IFNγ. FIG. 41B illustrates plasma concentration of IL-10. FIG. 41C illustrates plasma concentration of IL-12p70. FIG. 41D illustrates plasma concentration of IL-10. FIG. 41E illustrates plasma concentration of IL-2. FIG. 41F illustrates plasma concentration of IL-4. FIG. 41G illustrates plasma concentration of IL-5. FIG. 41H illustrates plasma concentration of IL-6. FIG. 41I illustrates plasma concentration of KC/GRO. FIG. 41J illustrates plasma concentration of TNF-α.

FIG. 47A illustrates systemic concentration of GCSF/CSF3. FIG. 47B illustrates systemic concentration of GMCSF.

FIG. 47C illustrates systemic concentration of MCSF. FIG. 47D illustrates systemic concentration of VEGF. FIG. 47E illustrates systemic concentration of LIF. FIG. 47F illustrates systemic concentration of Exotaxin. FIG. 47G illustrates systemic concentration of GROA.

FIG. 47H illustrates systemic concentration of IP10. FIG. 47 illustrates systemic concentration of LIX. FIG. 47J illustrates systemic concentration of MCP1. FIG. 47K illustrates systemic concentration of MCP3. FIG. 47L illustrates systemic concentration of MIP1α. FIG. 47AA illustrates systemic concentration of IL-17A. FIG. 47BB illustrates systemic concentration of IL-18. FIG. 47CC illustrates systemic concentration of IL-23. FIG. 47DD illustrates systemic concentration of IL-27. FIG. 47EE illustrates systemic concentration of IL-28. FIG. 47FF illustrates systemic concentration of IL-31. FIG. 47GG illustrates systemic concentration of IFN-α. FIG. 47HH illustrates systemic concentration of IFN-γ. FIG. 47II illustrates systemic concentration of TNF-α. FIG. 47JJ illustrates systemic concentration of IL-10. FIG. 47KK illustrates systemic concentration of IL-22. FIG. 47LL illustrates systemic concentration of TGF-β.

FIG. 48A illustrates plasma concentration of IFNγ. FIG. 48B illustrates plasma concentration of IL-1β. FIG. 48C illustrates plasma concentration of IL-12p70. FIG. 48D illustrates plasma concentration of IL-10. FIG. 48E illustrates plasma concentration of IL-2. FIG. 48F illustrates plasma concentration of IL-4. FIG. 48G illustrates plasma concentration of IL-5. FIG. 48H illustrates plasma concentration of IL-6. FIG. 48I illustrates plasma concentration of KC/GRO. FIG. 48J illustrates plasma concentration of TNF-α. Data are expressed as mean SEM.

FIG. 49A illustrates systemic plasma concentration of IL-1Ra. FIG. 49B illustrates gene expression of IL-1Ra in colonic tissue of naive, vehicle, and 9 mg/kg IL-10 delivery construct treated mice. FIG. 49C illustrates gene expression of IL-10 in colonic tissue of naive, vehicle, and 9 mg/kg IL-10 delivery construct of SEQ ID NO. 5 treated mice. FIG. 49D illustrates the IL-1Ra/IL-1β ratio. mRNA transcript levels were normalized to GAPDH. Data are expressed as mean SEM.

FIG. 57A illustrates systemic concentrations of the IL-10 delivery construct, as detected by anti-cholix or anti-IL-10 detection antibodies. FIG. 57B illustrates systemic concentrations of IL-1Ra following DSS insult.

FIG. 61A illustrates plasma concentration of IFNγ. FIG. 61B illustrates plasma concentration of IL-10. FIG. 61C illustrates plasma concentration of IL-2. FIG. 61D illustrates plasma concentration of IL-8. FIG. 61E illustrates plasma concentration of IL-6.

FIG. 71A illustrates systemic concentration of IL-10. FIG. 71B illustrates systemic concentration of IL-10 delivery construct (SEQ ID NO: 5). FIG. 71C illustrates systemic concentration of IL-1Ra.

FIG. 81A is a section of naïve colon, FIG. 81B is a section from a colon of a mouse treated with oxazolone, and FIG. 81C is a section of a colon from a mouse treated with oxazolone and 8.5 mg/kg of an IL-10 delivery construct (SEQ ID NO: 5).

FIG. 82A shows expression of IL-4. FIG. 82B shows expression of IL-6. FIG. 82C shows expression of IL-10. FIG. 82D shows expression of IL-17A. FIG. 82E shows expression of IL-10. FIG. 82F shows expression of MIP1α. FIG. 82G shows expression of GCSF/CSF3. *$p<0.05$; 1-way ANOVA with Tukey's post test.

FIG. 90A illustrates systemic concentrations of IL-10 after delivery of the IL-10 delivery construct orally (PO, N=6), subcutaneously (SC, N=3), or intravenously (IV, N=3) at the indicated doses in *Macaca fascicularis* monkeys. FIG. 90B illustrates systemic concentrations of IL-1Ra after delivery of the IL-10 delivery construct orally (PO, N=6), subcutaneously (SC, N=3), or intravenously (IV, N=3) at the indicated doses in *Macaca fascicularis* monkeys.

FIG. 103 illustrates dissolution of HPMC-AS coated F3 tablets on a Type 2 dissolution apparatus.

Figure 104A:
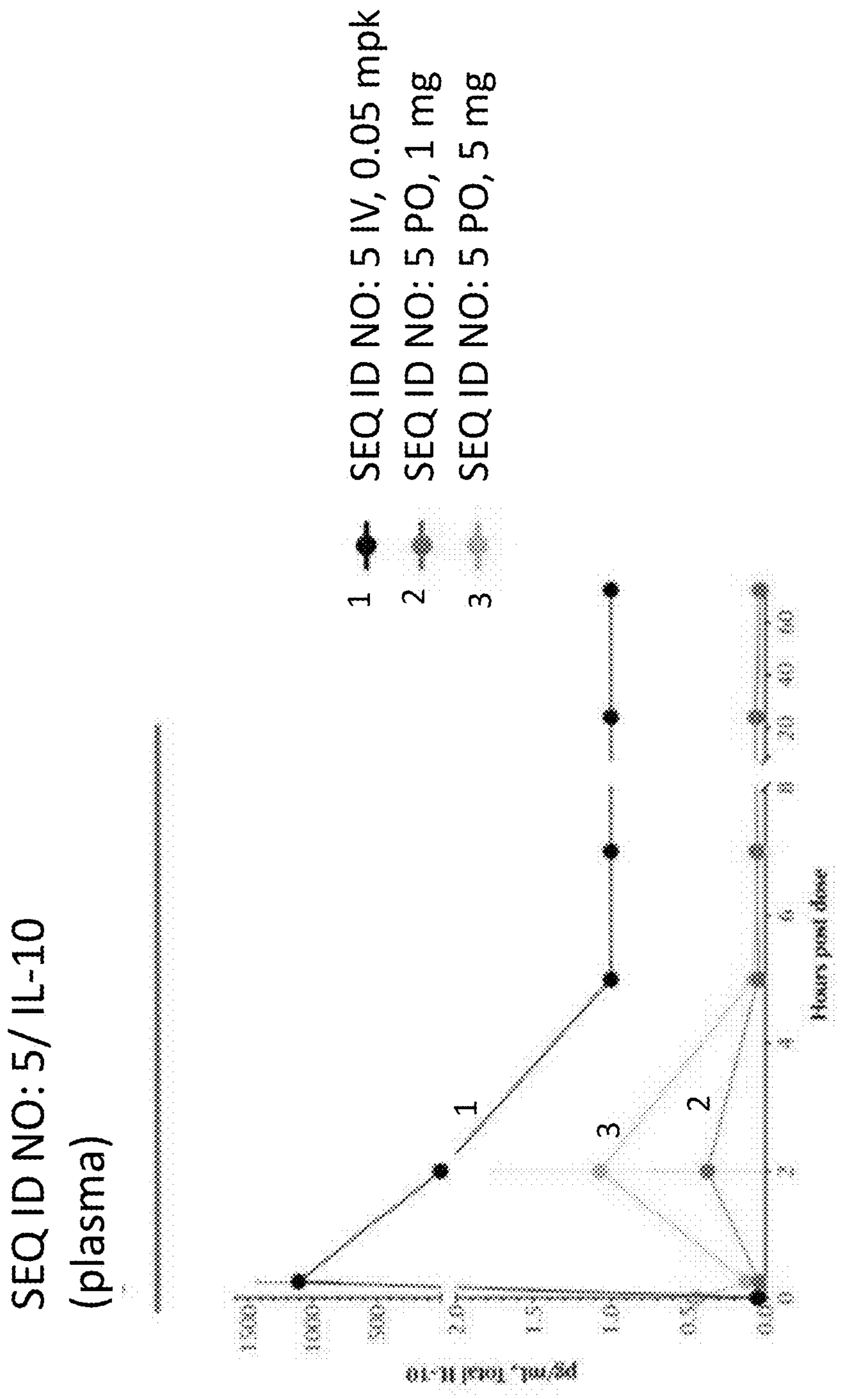
Figure 104B:
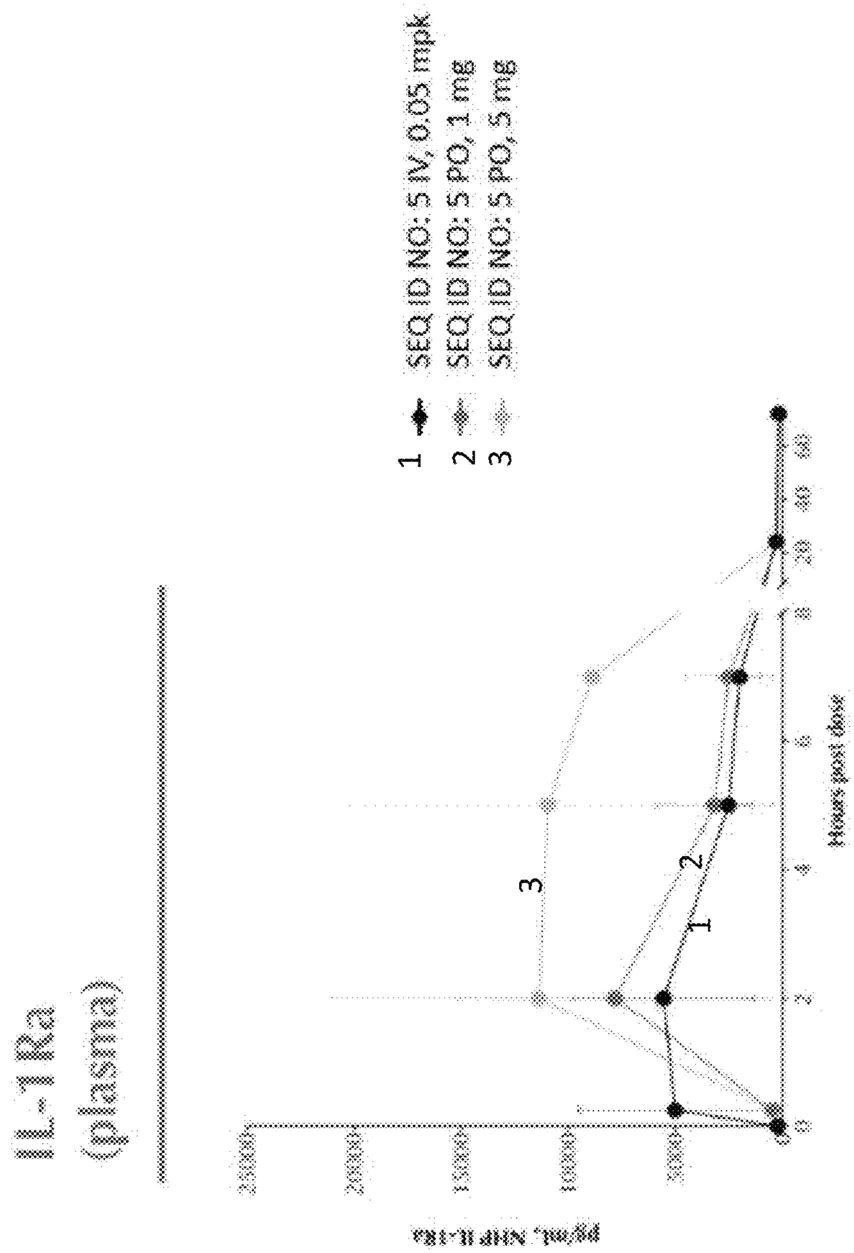
Figure 104C:
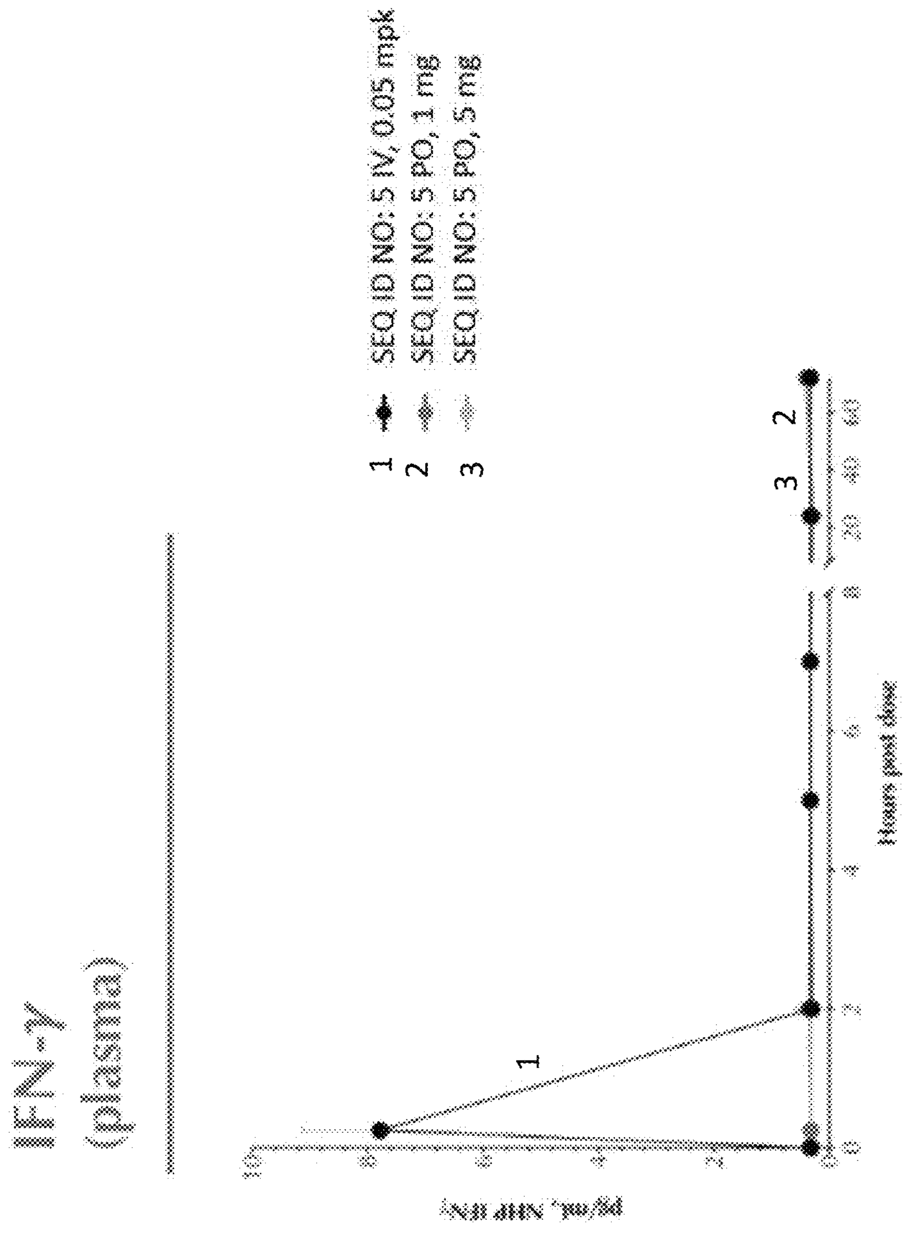

FIGS. 104A-104C illustrate plasma concentration of various proteins (e.g., biomarkers) following oral or intravenous delivery of an IL-10 delivery construct (SEQ ID NO:5). FIG. 104A illustrates plasma concentration of IL-10. FIG. 104B illustrates plasma concentration of IL-1Ra. FIG. 104C illustrates concentration of IFN-γ.

Figure 105A:
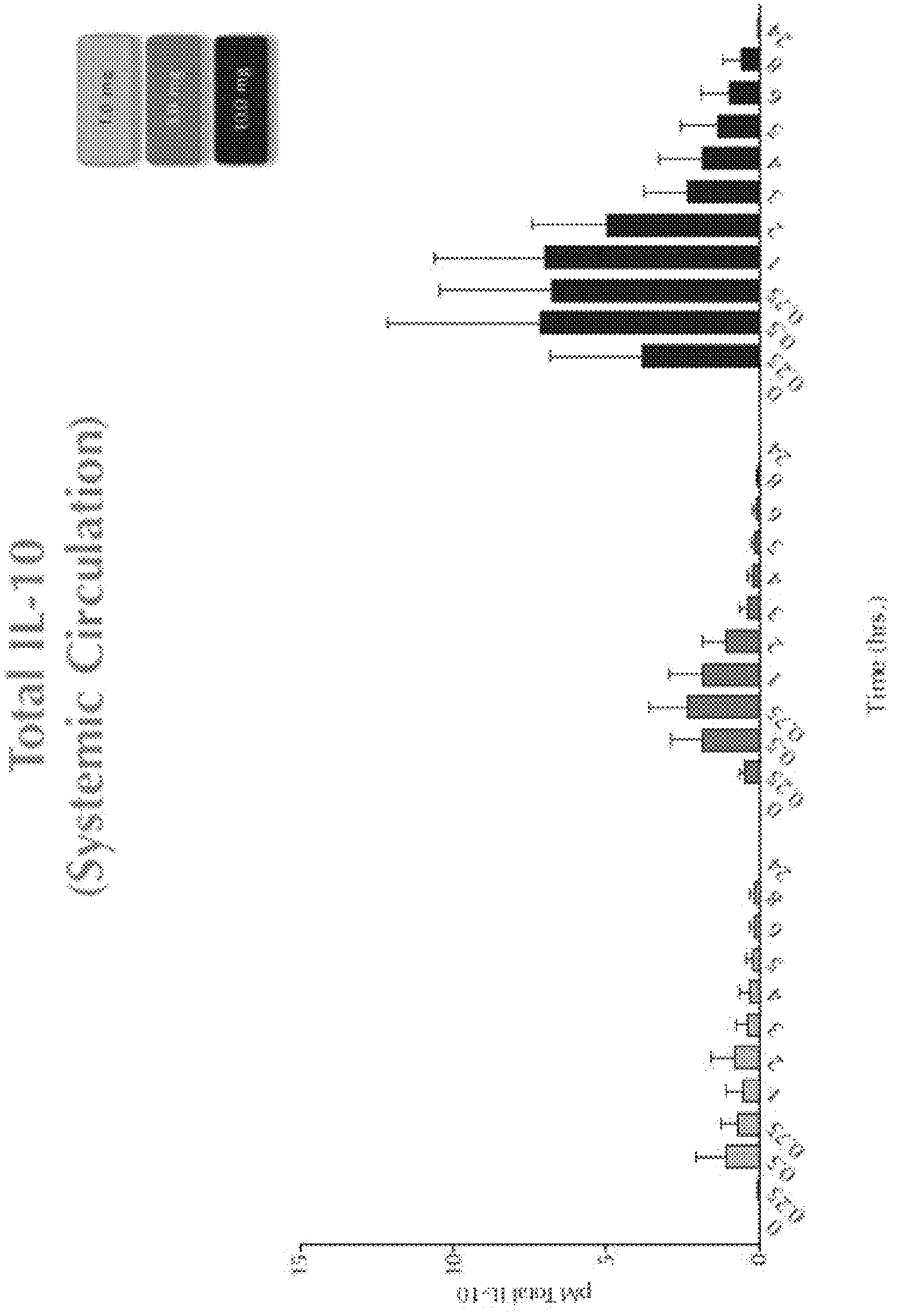
Figure 105B:
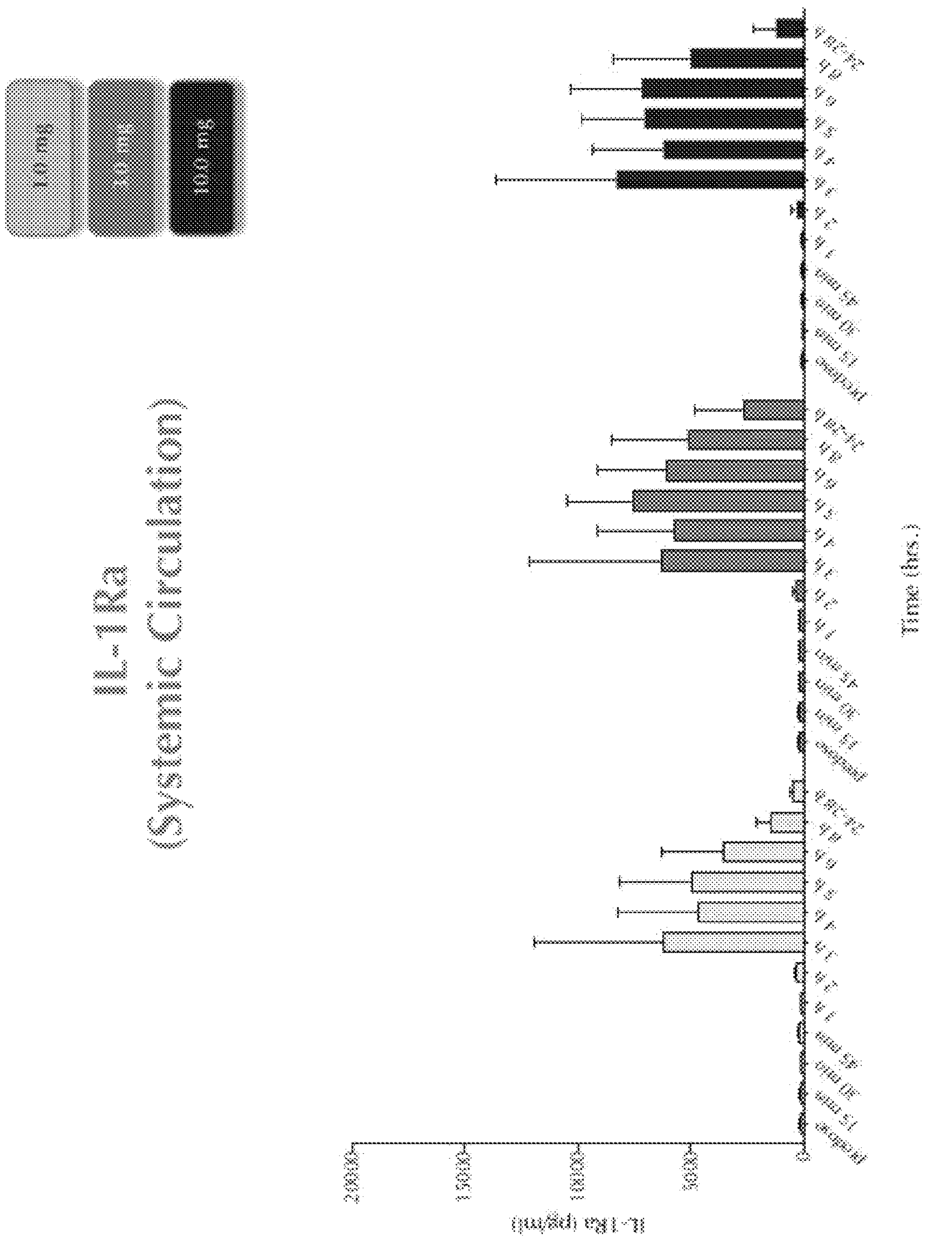
Figure 105D:
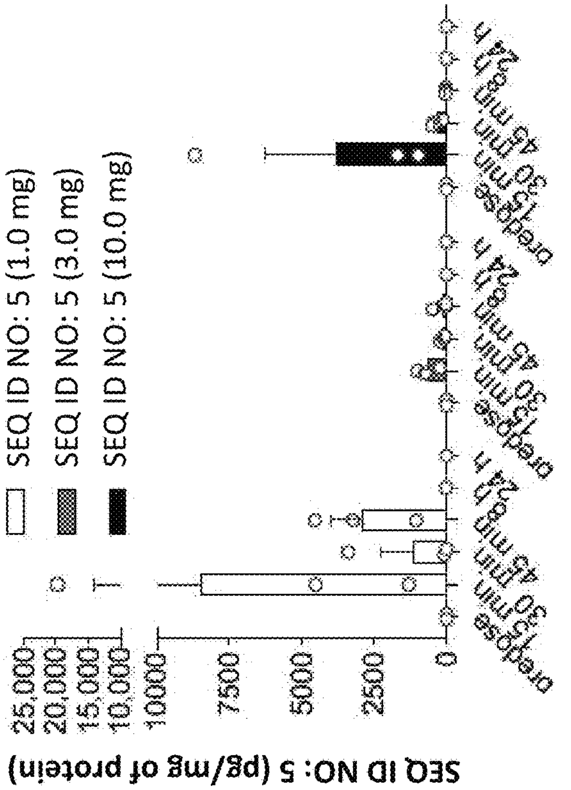
Figure 105C:
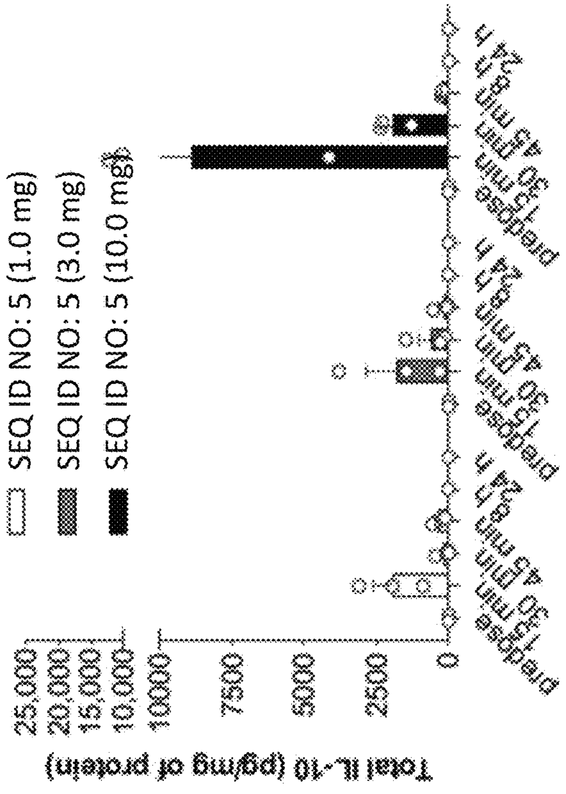

FIGS. 105A-105D illustrate systemic or colon tissue concentration of various biomarkers following pan-colonic delivery of IL-10 delivery construct (SEQ ID NO: 5) in non-human primates (NHP). FIG. 105A illustrates systemic concentration of IL-10. FIG. 105B illustrates systemic concentration of IL-1Ra. FIG. 105C illustrates the concentration of IL-10 in colon tissue. FIG. 105D illustrates the concentration of IL-10 delivery construct (SEQ ID NO: 5) in colon tissue.

Figure 106A:
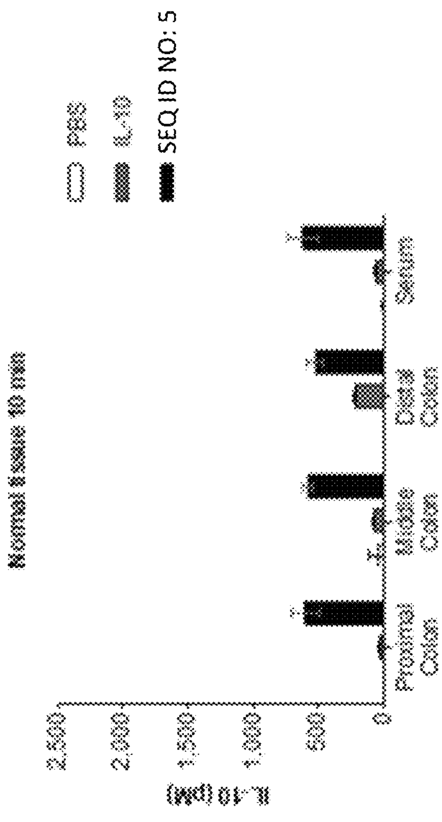
Figure 106B:
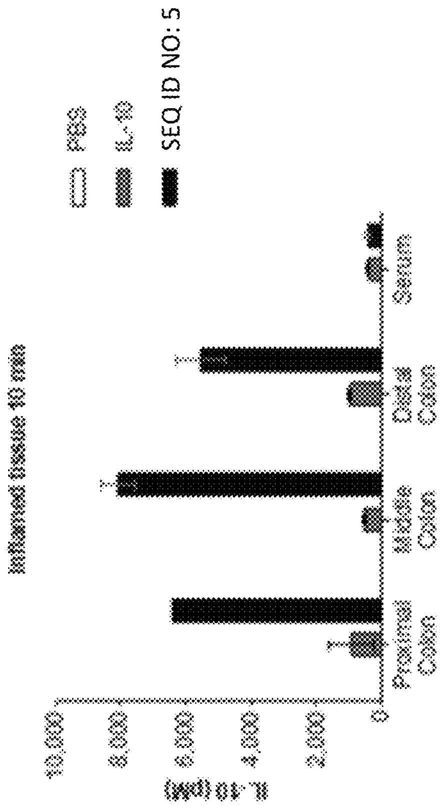
Figure 106D:
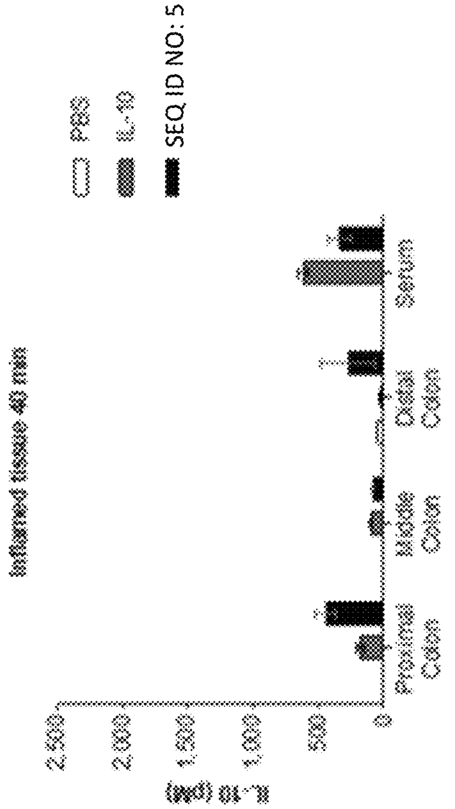
Figure 106C:
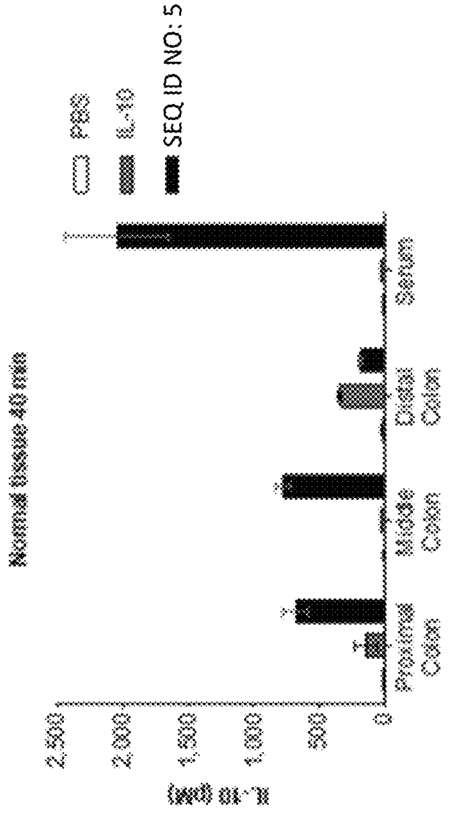

FIGS. 106A-106D illustrate rhIL-10 levels, as measured by ELISA, in normal and inflamed intestinal tissue (proximal, mid, and distal colon) and serum within 10 and 40 minutes of intraluminal injection of PBS, rhIL-10 (159 pmoles) or IL-10 delivery construct (SEQ ID NO: 5) (159 pmoles). FIG. 106A illustrates rhIL-10 levels in normal intestinal tissue 10 minutes after intraluminal injection of PBS, rhIL-10 or IL-10 delivery construct (SEQ ID NO: 5). FIG. 106B illustrates rhIL-10 levels in inflamed intestinal tissue 10 minutes after intraluminal injection of PBS, rhIL-10 or IL-10 delivery construct (SEQ ID NO: 5). FIG. 106C illustrates rhIL-10 levels in normal intestinal tissue 40 minutes after intraluminal injection of PBS, rhIL-10 or IL-10 delivery construct (SEQ ID NO: 5). FIG. 106D illustrates rhIL-10 levels in inflamed intestinal tissue 40 minutes after intraluminal injection of PBS, rhIL-10 or IL-10 delivery construct (SEQ ID NO: 5).

Figure 107:
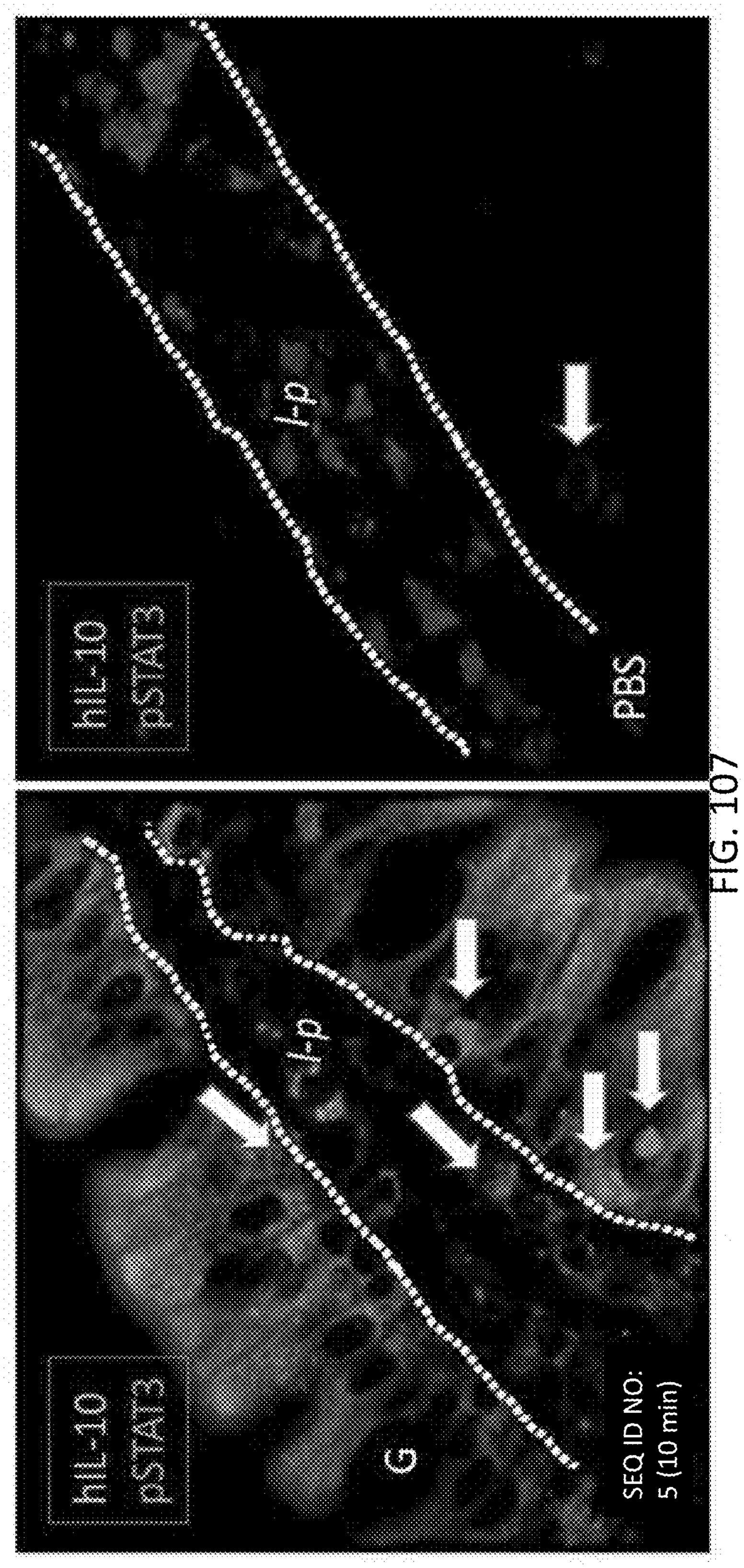

FIG. 107 illustrates tissue localization of rhIL-10 and pSTAT3 after intraluminal injection of IL-10 delivery construct (SEQ ID NO: 5) into the jejunum of Balb/C mice.

Figure 108:
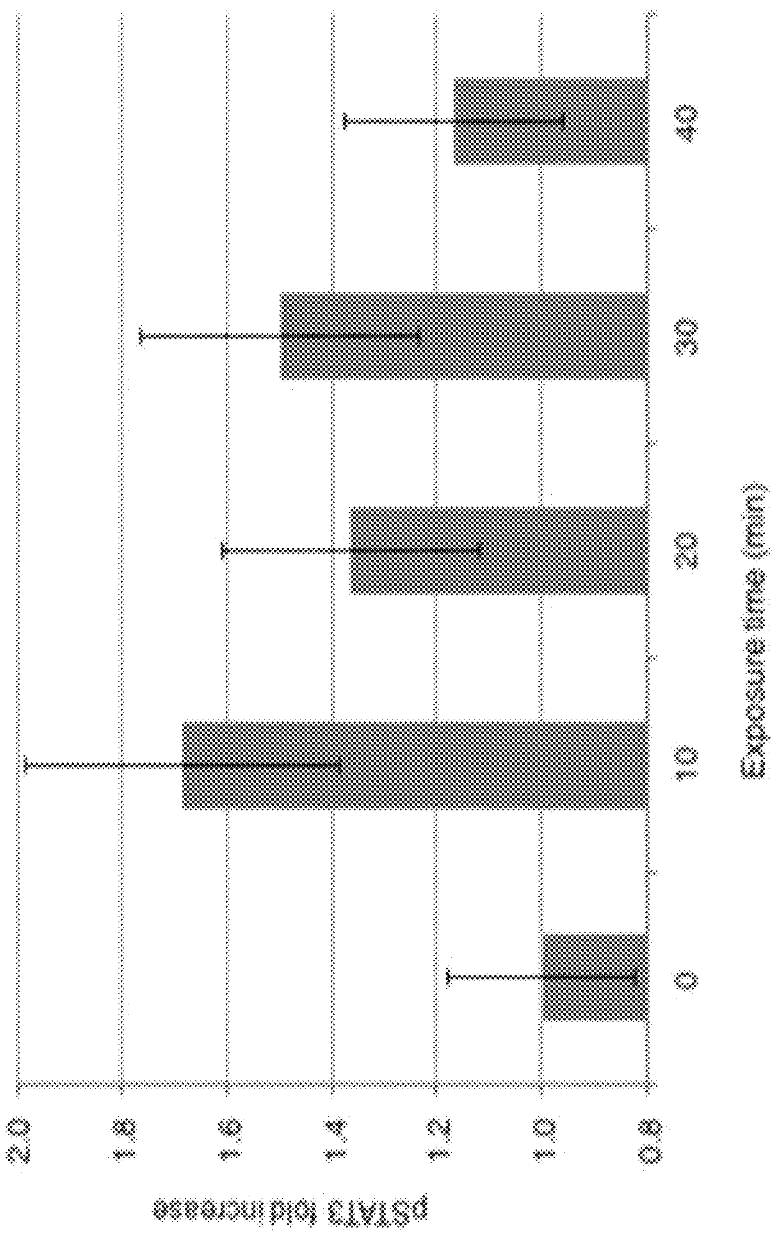

FIG. 108 illustrates a time course analysis of pSTAT induction following intraluminal injection of IL-10 delivery construct (SEQ ID NO: 5) into the jejuum of Balb/C mice.

Figure 109:
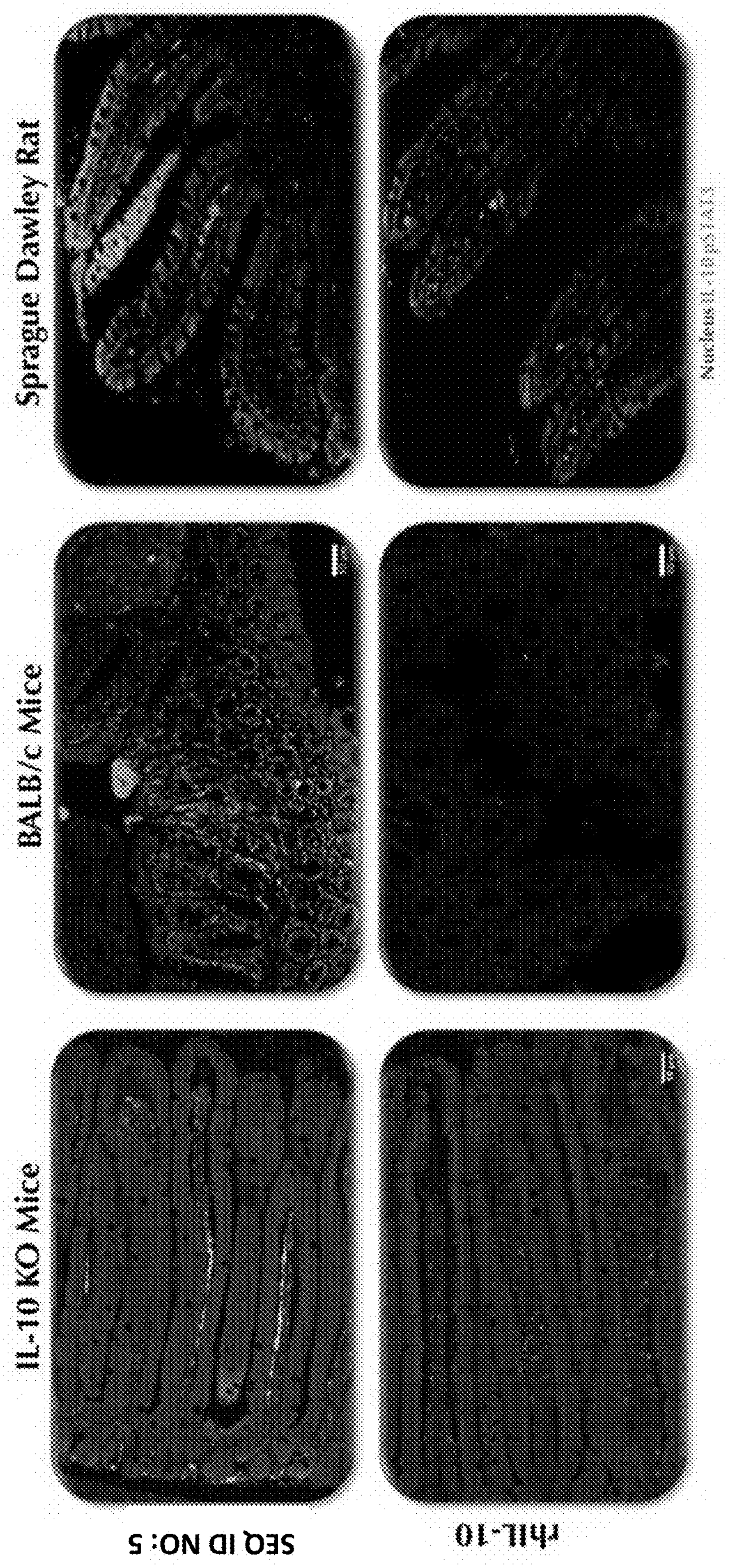

FIG. 109 illustrates immunofluorescence images of IL-10 delivery construct (SEQ ID NO: 5) trafficking across intestinal epithelium in different murine models.

Figure 110:
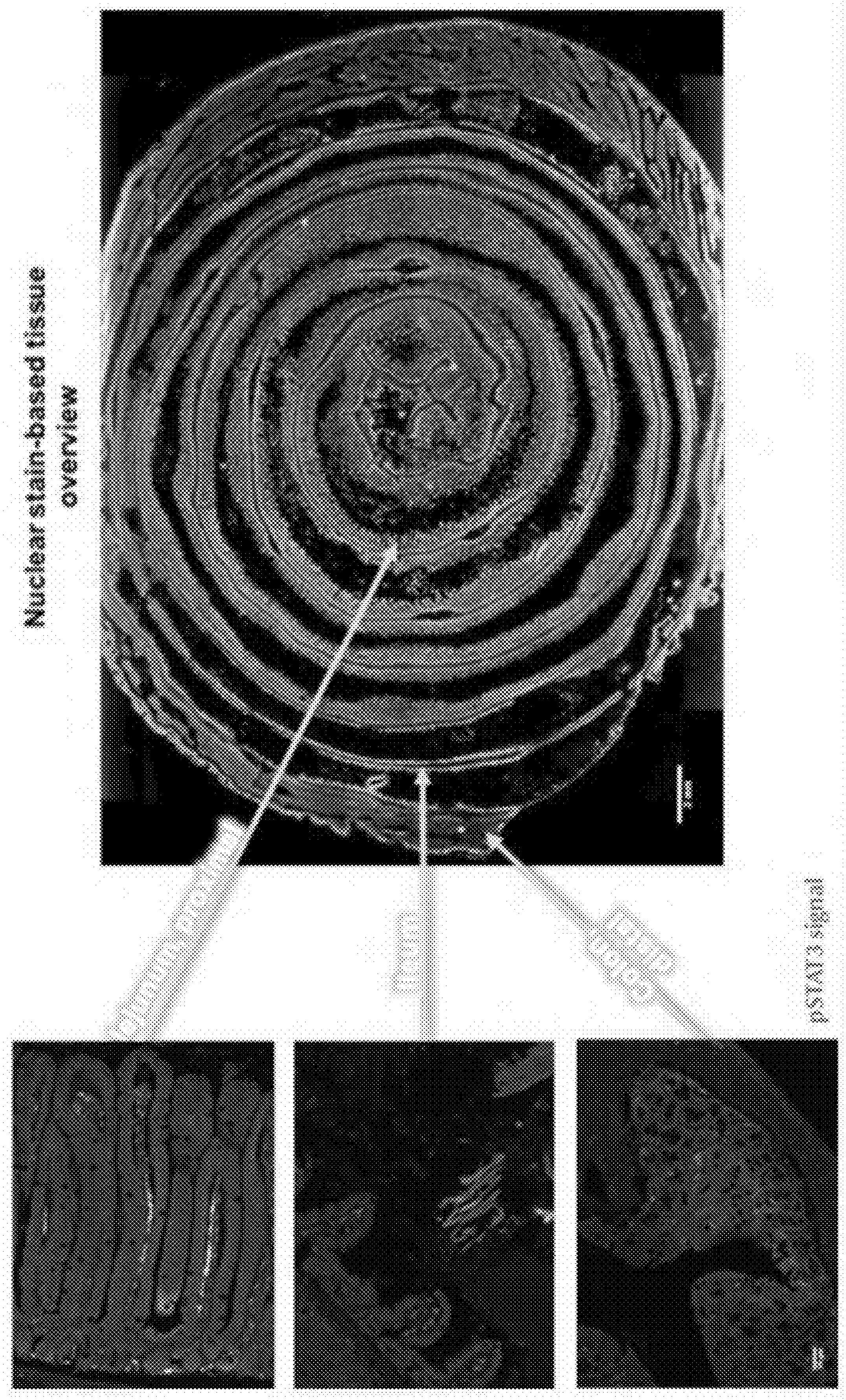

FIG. 110 illustrates pSTAT3 activity along the lamina propria of mouse intestine.

Figure 111:
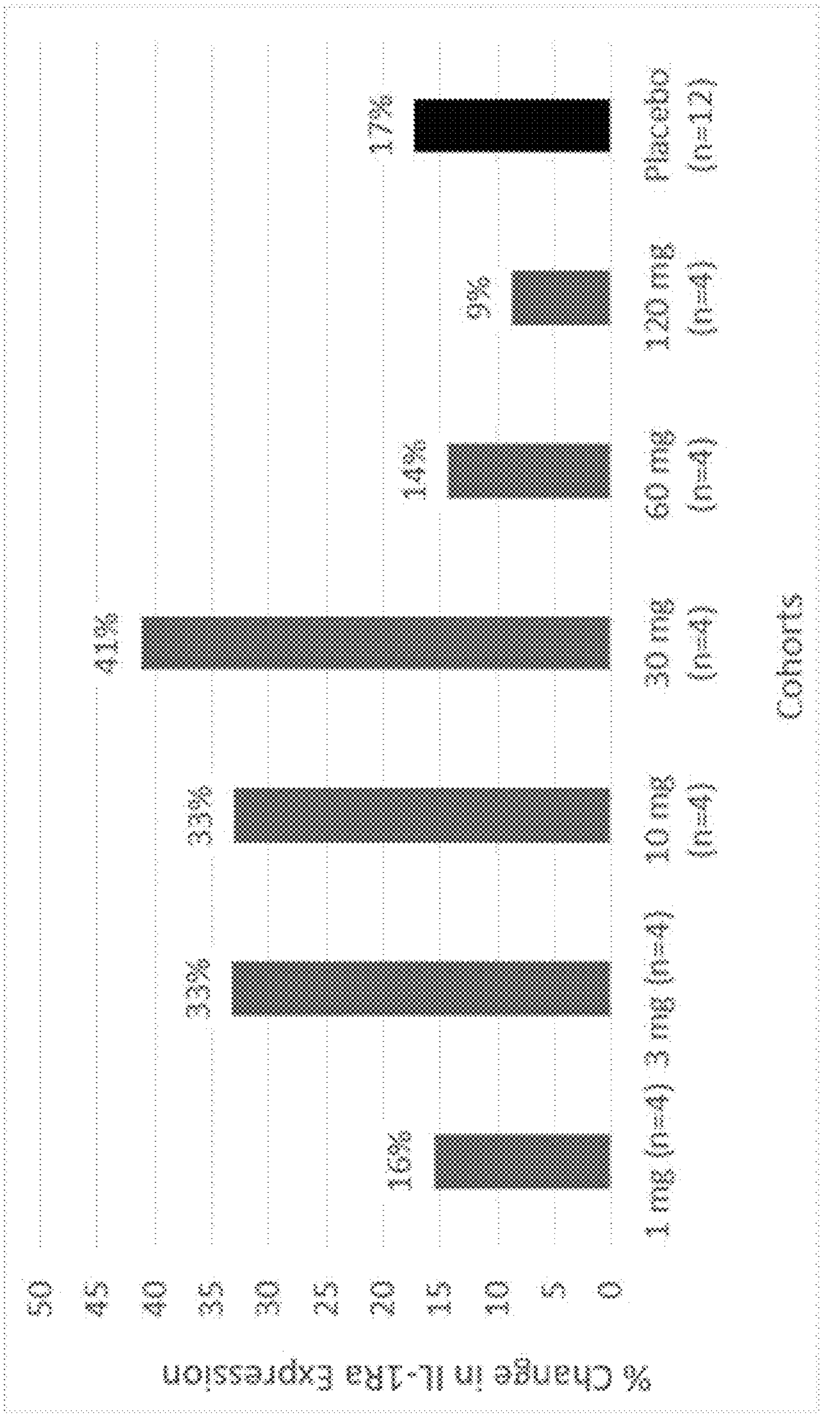

FIG. 111 illustrate IL-1Ra expression following a single dose of IL-10 delivery construct (SEQ ID NO: 5) at 6 doses (1 mg, 3 mg, 10 mg, 30 mg, 60 mg, 120 mg) or placebo.

Figure 112:
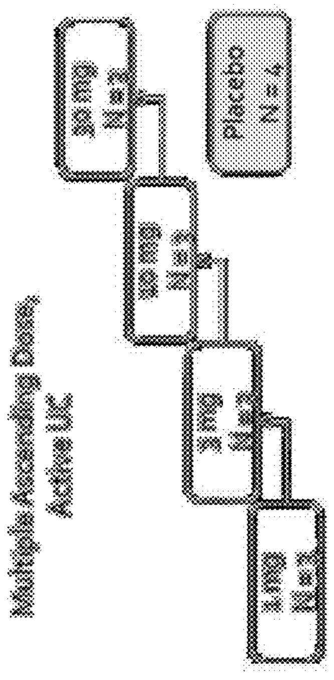

FIG. 112 illustrates multiple ascending dose (MAD) escalation in a Phase 1b trial of the IL-10 delivery construct (SEQ ID NO: 5).

Figure 113:
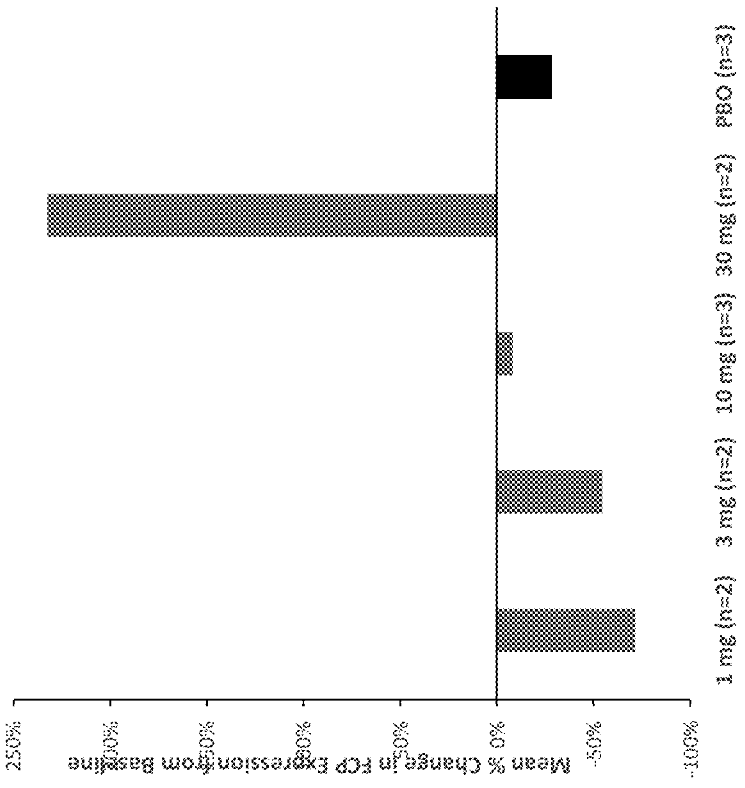

FIG. 113 illustrates a reduction in FCP after only 14-days of treatment with the IL-10 delivery construct (SEQ ID NO: 5) in Ulcerative Colitis (UC) patients with baseline FCP >150 μg/g.

Figure 114:
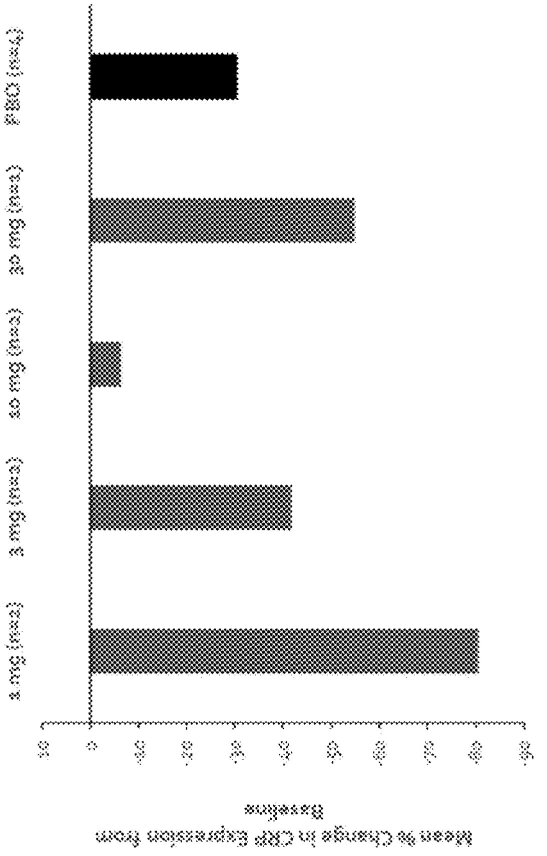

FIG. 114 illustrates a reduction in CRP in systemic circulation after only 14-days of treatment with the IL-10 delivery construct (SEQ ID NO: 5) in UC patients with baseline CRP >5 mg/L.

Figure 115:
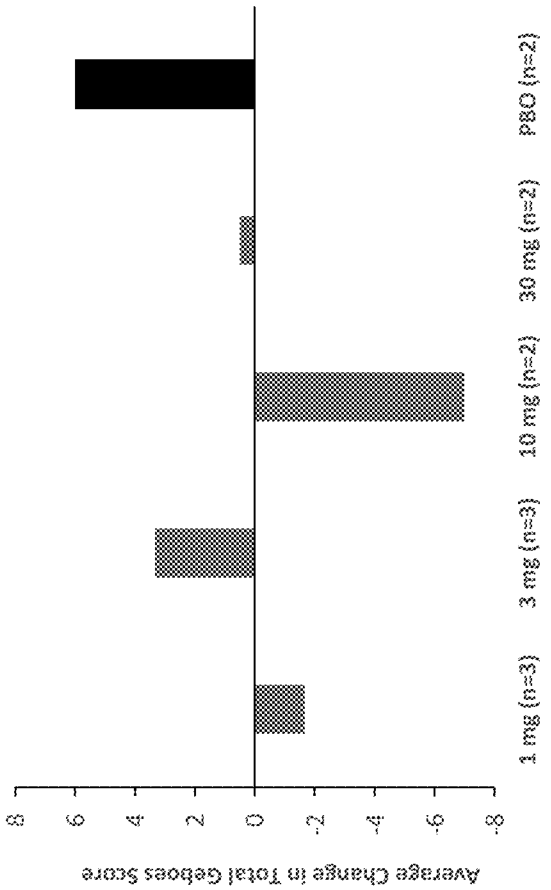

FIG. 115 illustrates reduction in Geboes score over 14-days of treatment with the IL-10 delivery construct (SEQ ID NO: 5).

Figure 116:
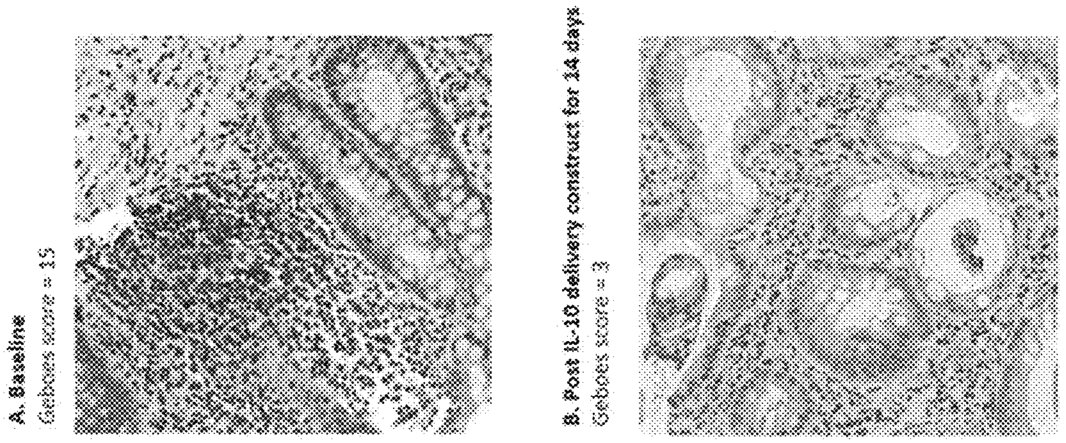

FIG. 116 depicts pre-dose (panel A) and post-treatment (panel B) histological images from a UC patient in the Phase 1b trial dosed with 10 mg of the IL-10 delivery construct (SEQ ID NO: 5) in which the Geboes score improved from a score of 15 to a score of three using a 22 point scale, with higher scores indicating more severe disease activity.

Figure 117B:
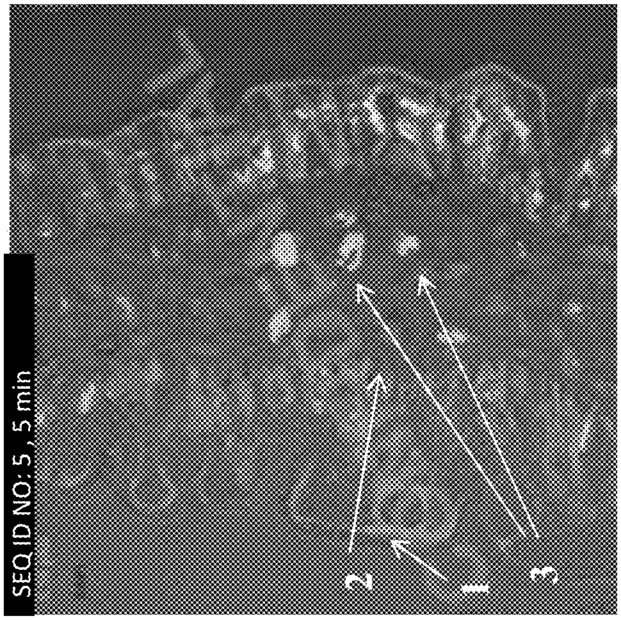
Figure 117A:
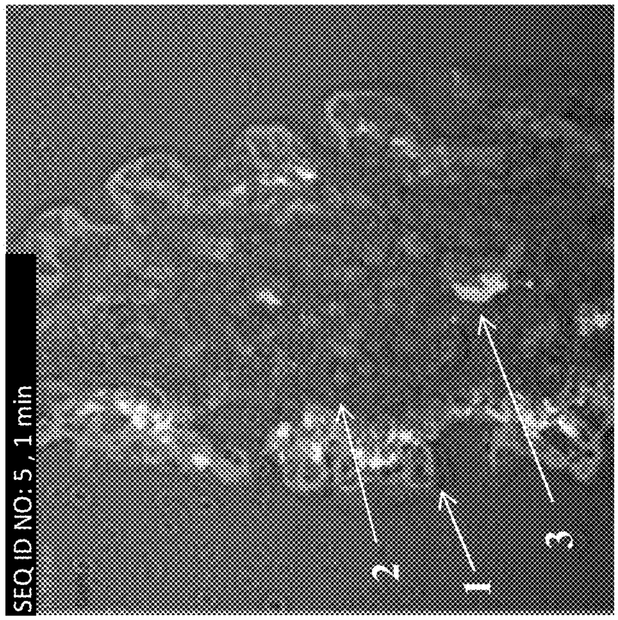
Figure 117C:
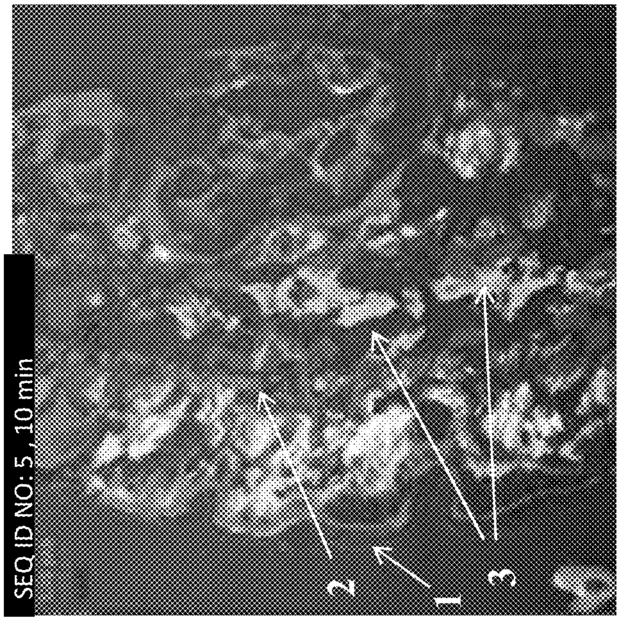

FIGS. 117A-117C show microscopy images demonstrating transcytosis of an IL-10 across polarized gut epithelial cells in Wistar rats at various time points following luminal application of the delivery construct with the sequence set forth in SEQ ID NO: 5 to rat jejunum. Green fluorescence indicates the presence of IL-10 (via staining with an anti-IL-10 antibody). Blue fluorescence indicates DAPI staining, which labels DNA, and red fluorescence indicates the presence of CK-8 (cytokeratin-8) with which a cholix-derived carrier can co-localize (e.g., in a supranuclear region of an epithelial cell) during transcytosis. White arrows #1 highlight the apical membrane of the epithelial cells, white arrows #2 highlight the basal membrane of the epithelial cells, and white arrow #3 indicates the presence of IL-10 in the lamina propria. FIG. 117A demonstrates the extent of transcytosis of IL-10 one minute after luminal application of the delivery construct with the sequence set forth in SEQ ID NO: 5 to rat jejunum. FIG. 117B demonstrates the extent of transcytosis of IL-10 five minutes after luminal application of the delivery construct with the sequence set forth in SEQ ID NO: 5 to rat jejunum. FIG. 117C demonstrates the extent of transcytosis of IL-10 ten minutes after luminal application of the delivery construct with the sequence set forth in SEQ ID NO: 5 to rat jejunum.

Figure 118:
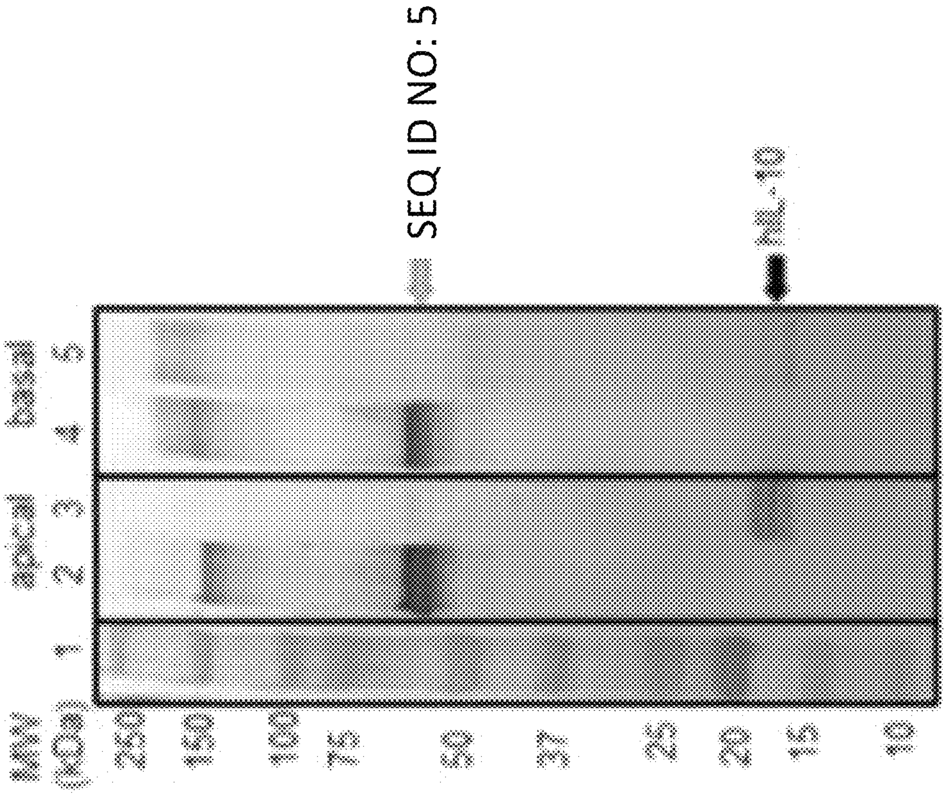

FIG. 118 illustrates results of an intestinal model system of confluent, polarized human SMI-100 monolayers. An anti-hIL-10 western blot detects the extent of the extent of equimolar applications of an IL-10 delivery construct (lane 2, apical, t=0 hr) or commercial hIL-10 (lane 3, apical, t=0 hr) transiting to the basal compartment of respective transwells (lane 4, IL-10 delivery construct, basal, t=2 hr and lane 5, hIL-10, basal, t=2 hr). Lanes from a single western blot were spliced together to facilitate comparisons and are indicated by black lines.

Figure 119:
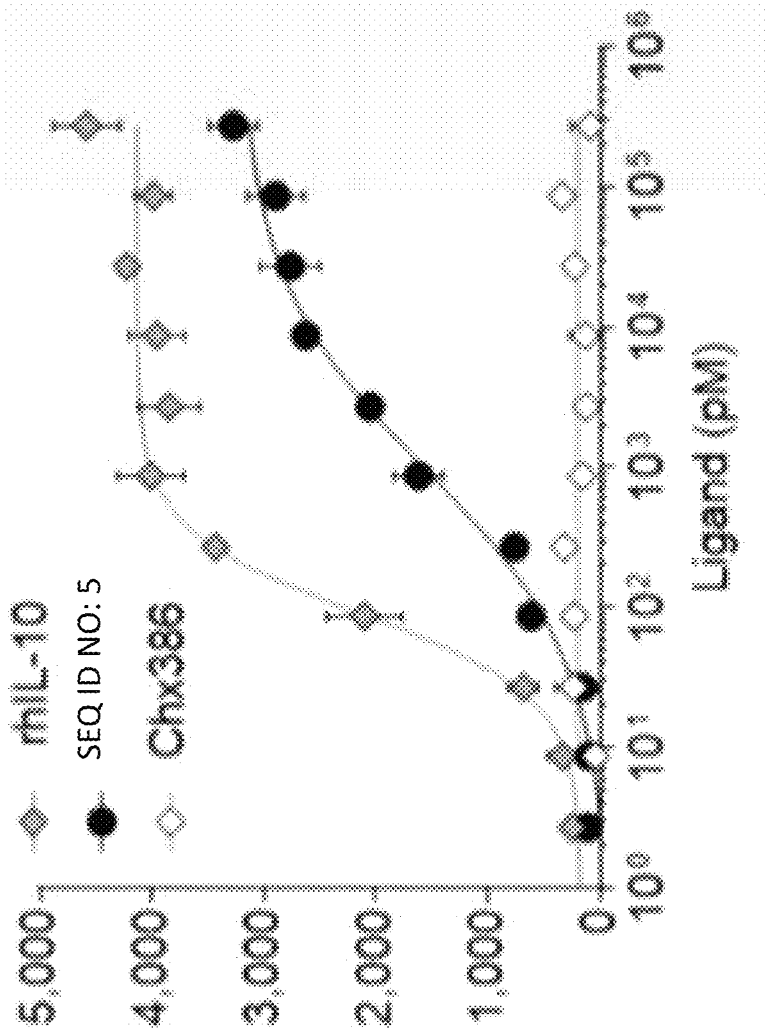

FIG. 119 illustrates dimerization of IL-10A and IL-10B receptors engineered into U2OS osteosarcoma cells induced by an IL-10 delivery construct or hIL-10 after 6 h.

Figure 120:
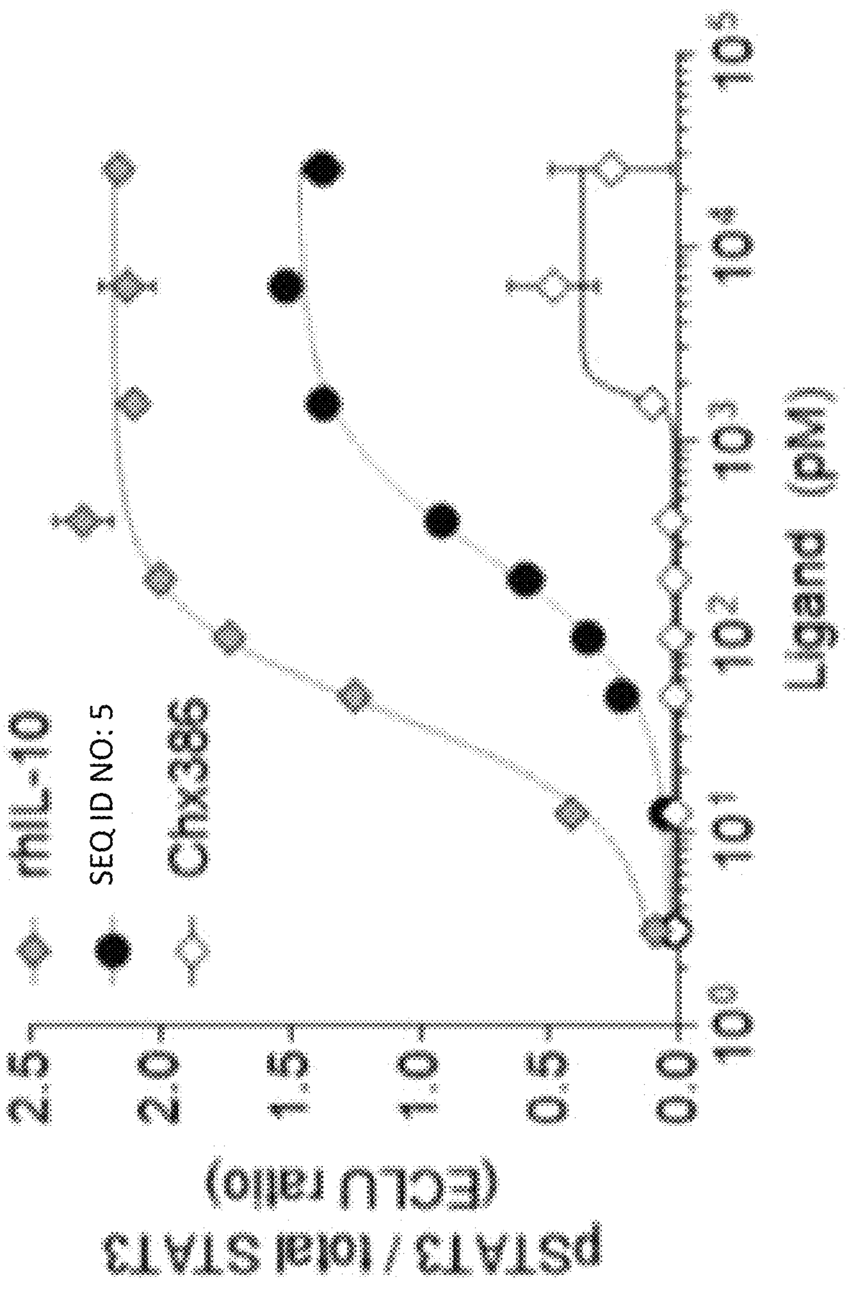

FIG. 120 illustrates induction of STAT3 phosphorylation, relative to total STAT3 content, in a mouse macrophage-like cell line J774.2 after 20 min of stimulation. Data is representative of multiple studies with similar results.

Figure 121:
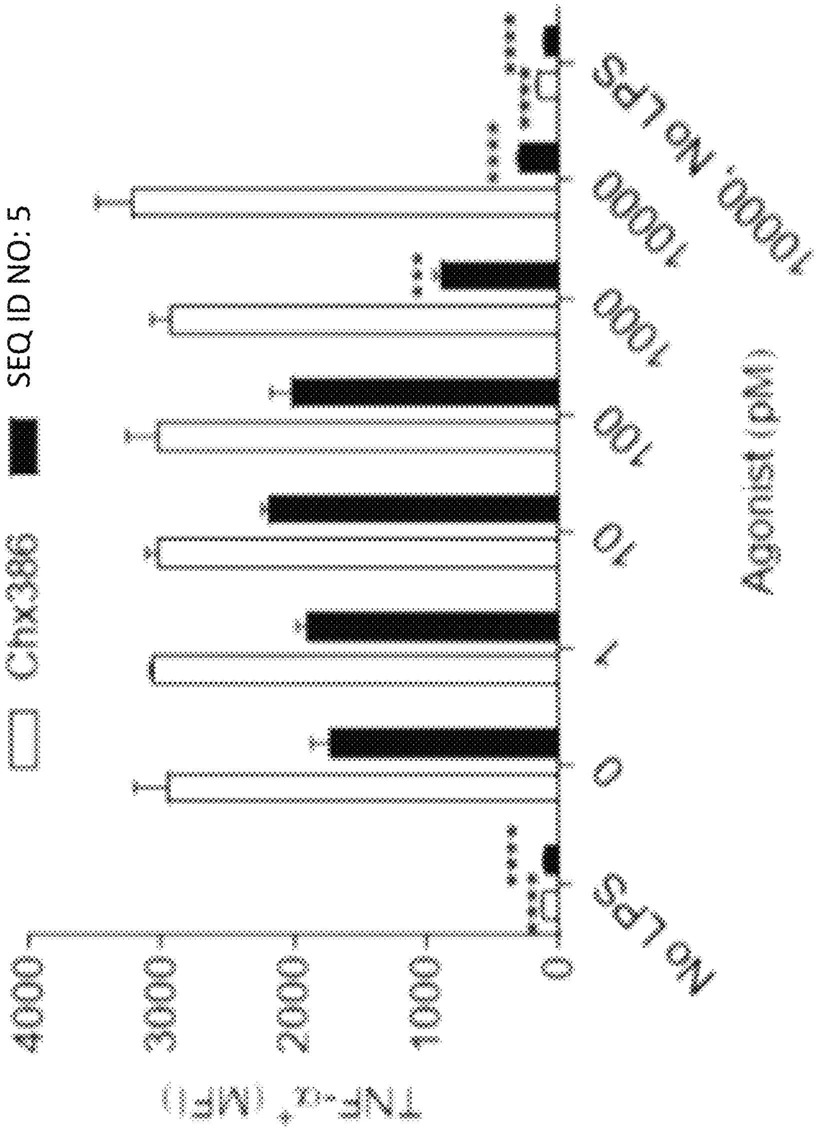

FIG. 121 illustrates flow cytometry analysis of gated, live CD45+CD14+ monocytes (PBMCs) obtained from healthy donors showing IL-10's suppressive effect on LPS-induced TNFα secretion; data of mean fluorescence intensity (MFI) as means SEM (n=3) analyzed by 2-way ANOVA with Dunnett's post-hoc test. .p<0.5, ..p<0.01, ".p<0.001, '...p<0.0001 when compared to 0 pM concentration values.

Figure 122:
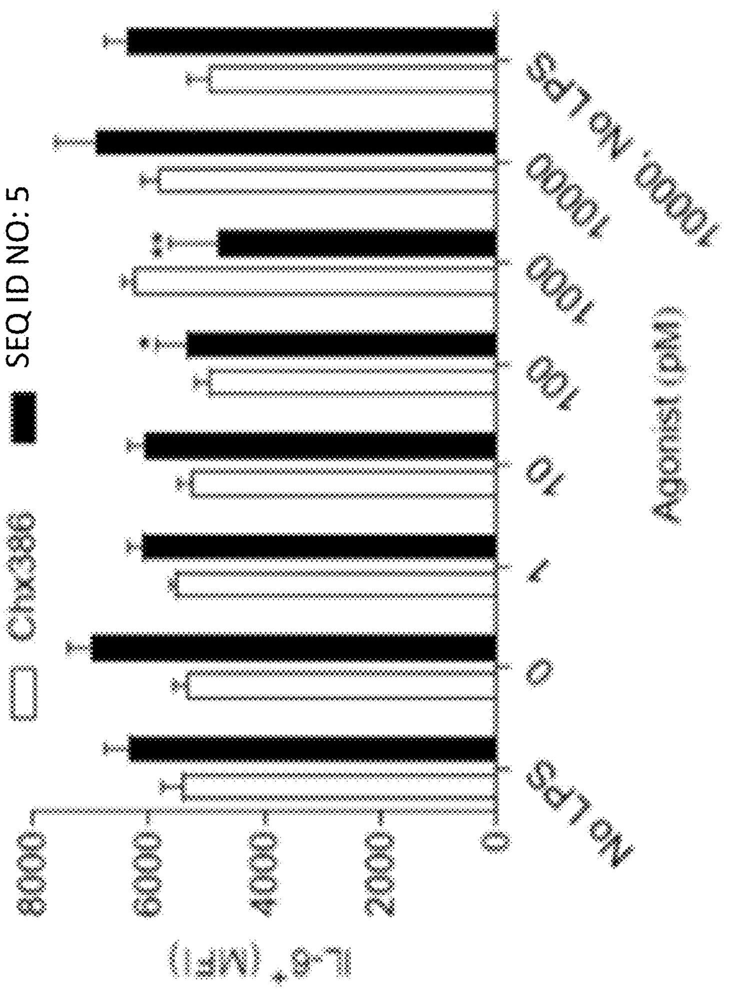

FIG. 122 illustrates flow cytometry analysis of gated, live CD45+CD14+ monocytes (PBMCs) obtained from healthy donors showing IL-10's suppressive effect on LPS-induced IL-6 secretion; data of mean fluorescence intensity (MFI) as means SEM (n=3) analyzed by 2-way ANOVA with Dunnett's post-hoc test. .p<0.5, ..p<0.01, ".p<0.001, '...p<0.0001 when compared to 0 pM concentration values.

Figure 123:
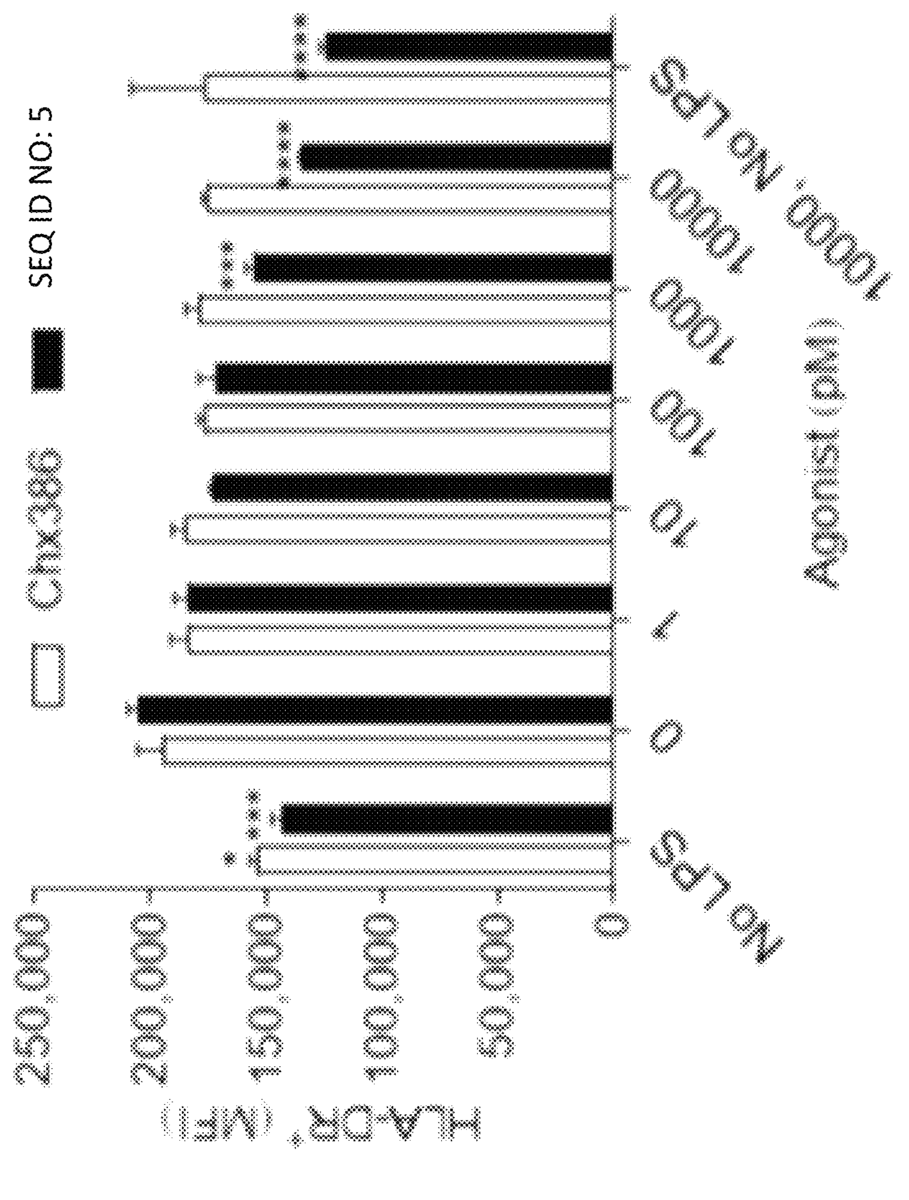

FIG. 123 illustrates flow cytometry analysis of gated, live CD45+CD14+ monocytes (PBMCs) obtained from healthy donors showing IL-10's suppressive effect on LPS-induced surface expression of HLA-DR; data of mean fluorescence intensity (MFI) as means SEM (n=3) analyzed by 2-way ANOVA with Dunnett's post-hoc test. .p<0.5, ..p<0.01, ".p<0.001, '...p<0.0001 when compared to 0 pM concentration values.

Figure 124:
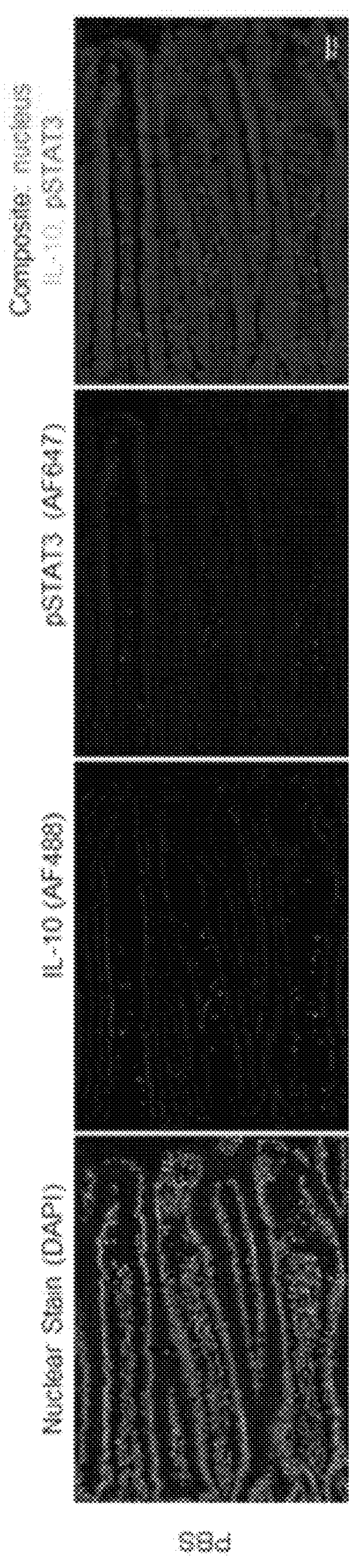

FIG. 124 illustrates the oxazolone-induced colitis in BALB/c mice orally gavaged with PBS. Single channel images were captured and merged into a composite with nuclei (blue), IL-10 (green), and pSTAT3 (red).

Figure 125:
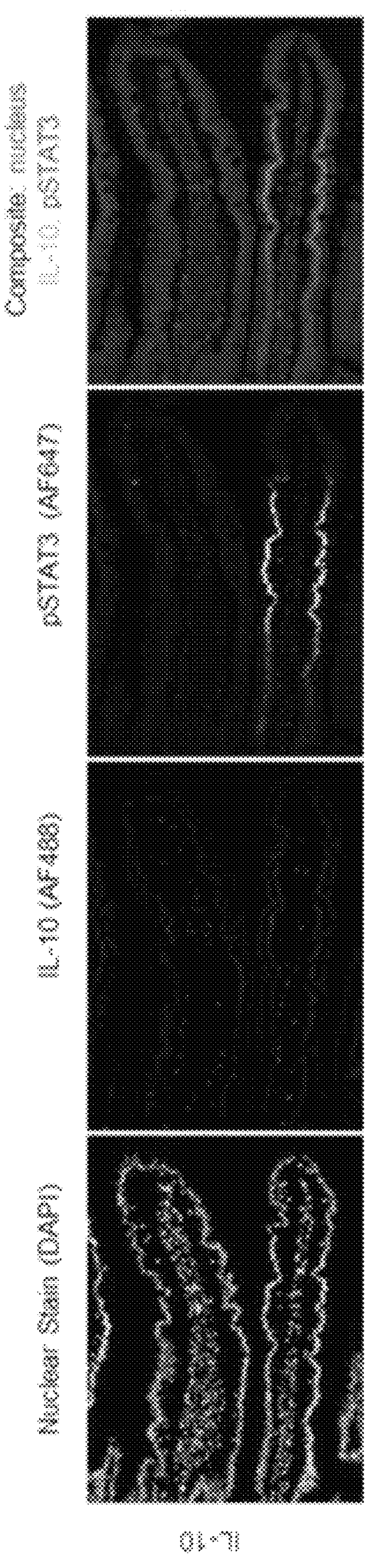

FIG. 125 illustrates the oxazolone-induced colitis in BALB/c mice orally gavaged with hIL-10. Single channel images were captured and merged into a composite with nuclei (blue), IL-10 (green), and pSTAT3 (red).

Figure 126:
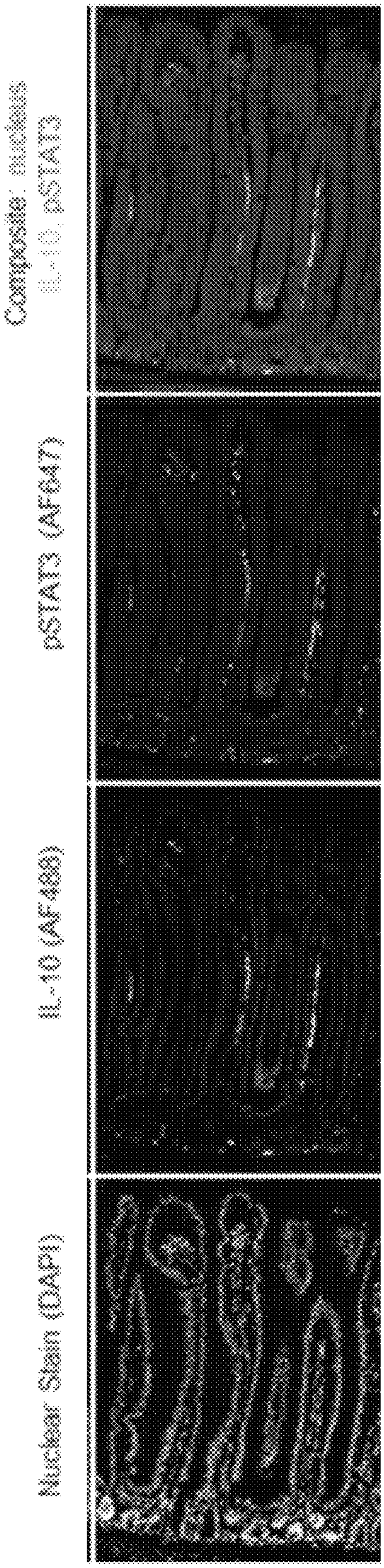

FIG. 126 illustrates the oxazolone-induced colitis in BALB/c mice orally gavaged with an IL-10 delivery construct. Single channel images were captured and merged into a composite with nuclei (blue), IL-10 (green), and pSTAT3 (red).

Figure 127:
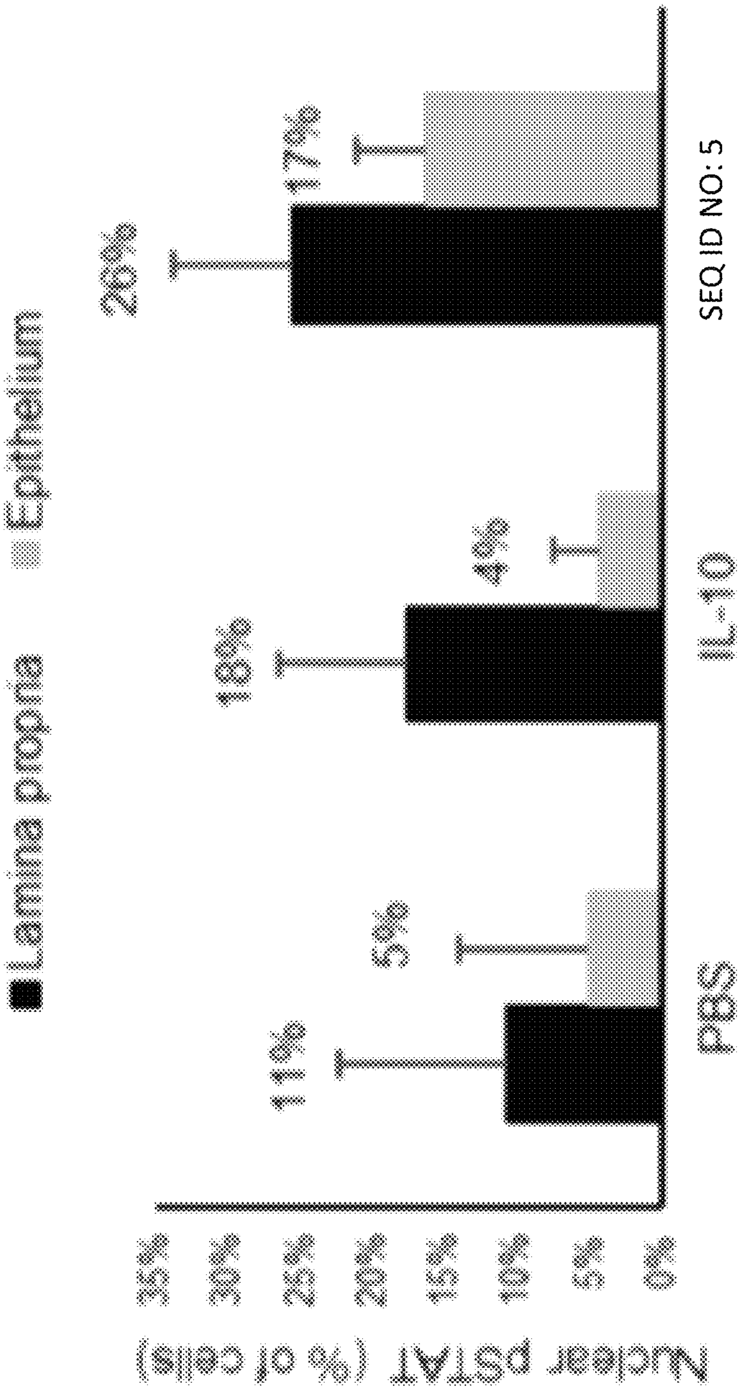

FIG. 127 illustrates the percent of cells expressing pSTAT3 in small intestine tissue segmentation.

Figure 128:
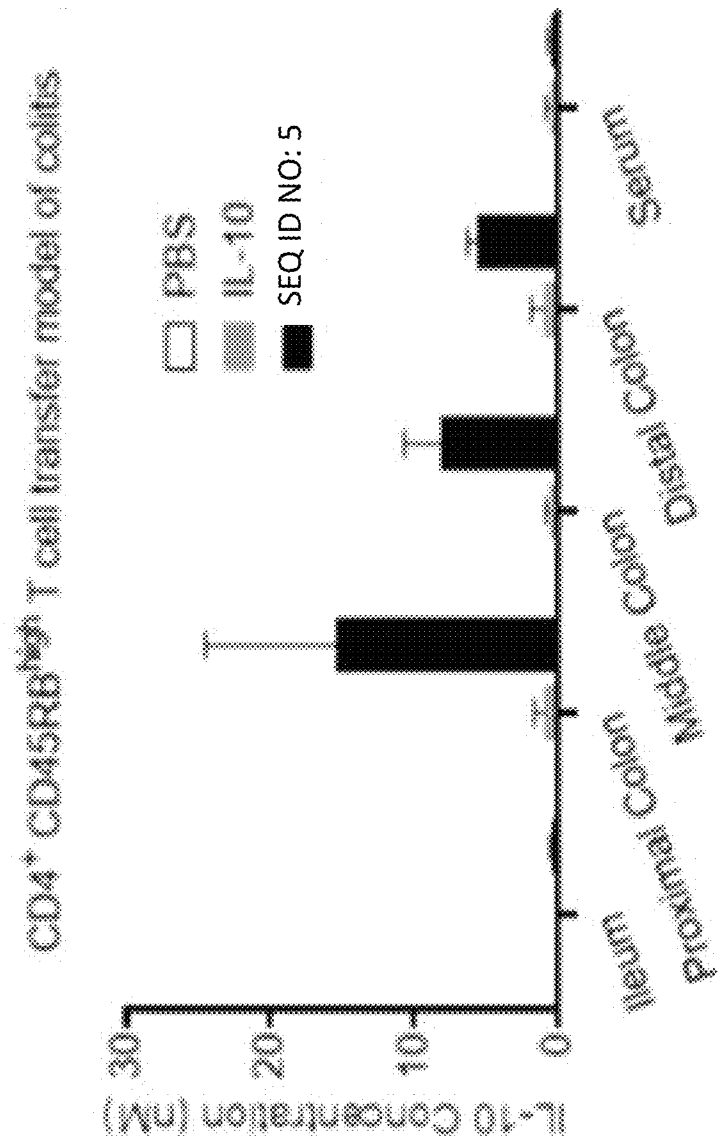

FIG. 128 illustrates results of an hIL-10 ELISA run with PBS, IL-10, and an IL-10 delivery construct post intraluminal injection on the indicated intestinal tissues and serum in the inflamed T cell transfer model.

Figure 129:
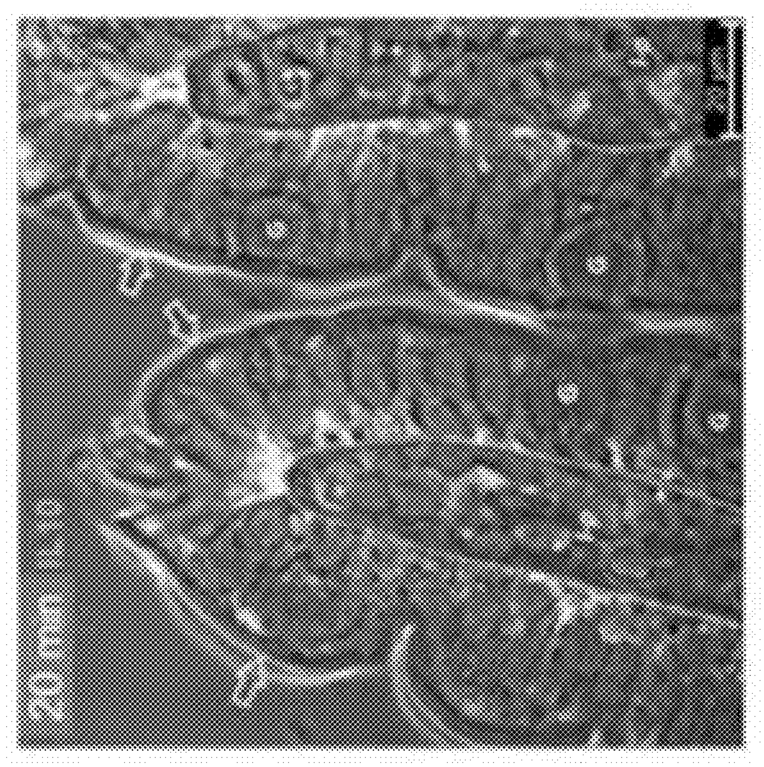

FIG. 129 illustrates co-localization of the cholix derived carrier (red) and hIL-10 (green) elements of the IL-10 delivery construct demonstrating their simultaneous transport and retention within cells of the lamina propria. Immunofluorescence microscopy images of rat jejunum were obtained following a 50 uL intraluminal injection of an IL-10 delivery construct prepared in PBS at ~40 uM. For FIGS. 129-133: arrow=apical (luminal) epithelial membrane; dashed line=epithelial cell-basement membrane demarcation; 1-p=lamina propria; G=goblet cell. Cell nuclei stained with DAPI (blue).

Figure 130:

FIG. 130 illustrates staining of the hIL-10 (green) element of the IL-10 delivery construct and Rab7 (red) demonstrated apical preferences for the former and basal preferences for the latter.

Figure 131:
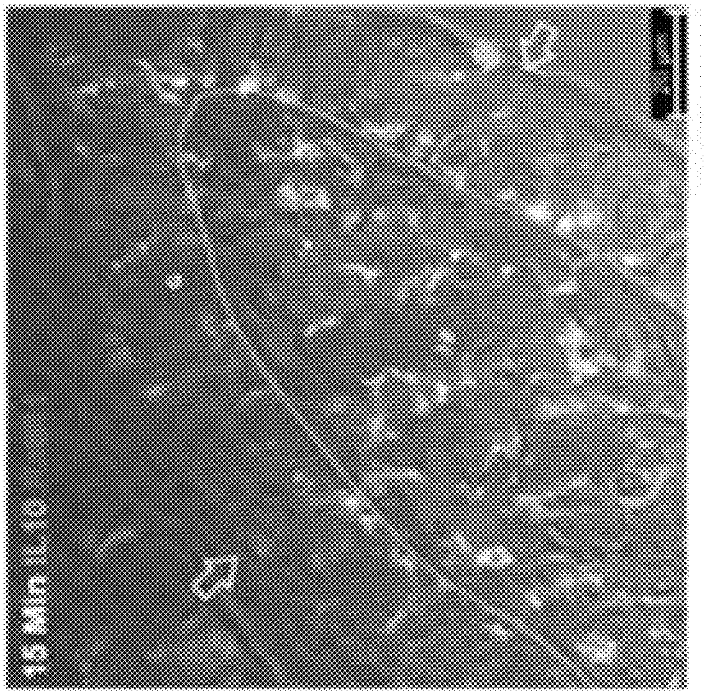

FIG. 131 illustrates staining of the hIL-10 (green) element of the IL-10 delivery construct and Rab11 (red) demonstrated apical preferences for the former and basal preferences for the latter.

Figure 132:
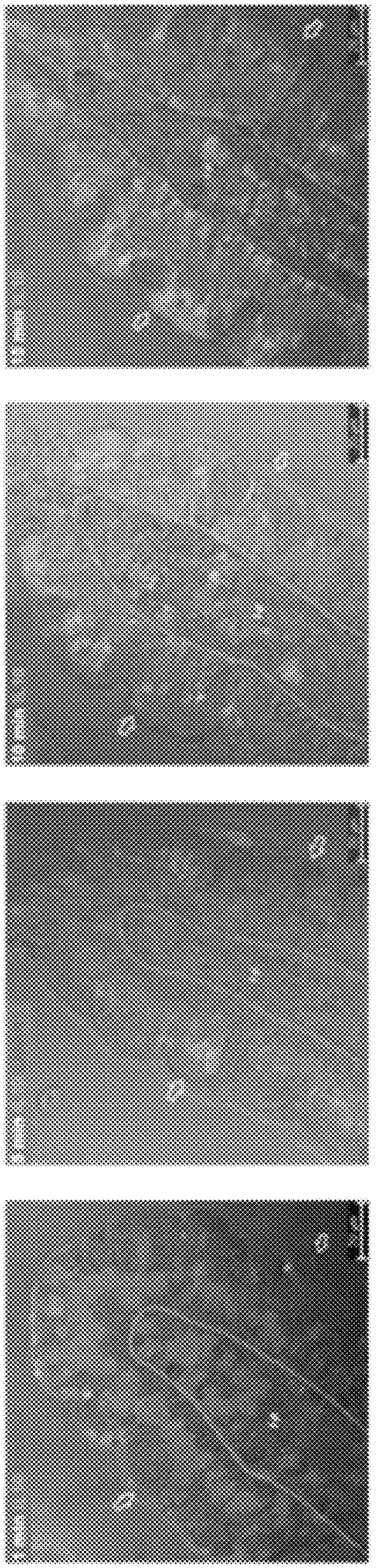

FIG. 132 illustrates LMAN1 reorganization and co-localization with the IL-10 delivery construct within enterocytes but not within cells of lamina propria in a time course following intraluminal injection of an IL-10 delivery construct into rat jejunum.

Figure 133:
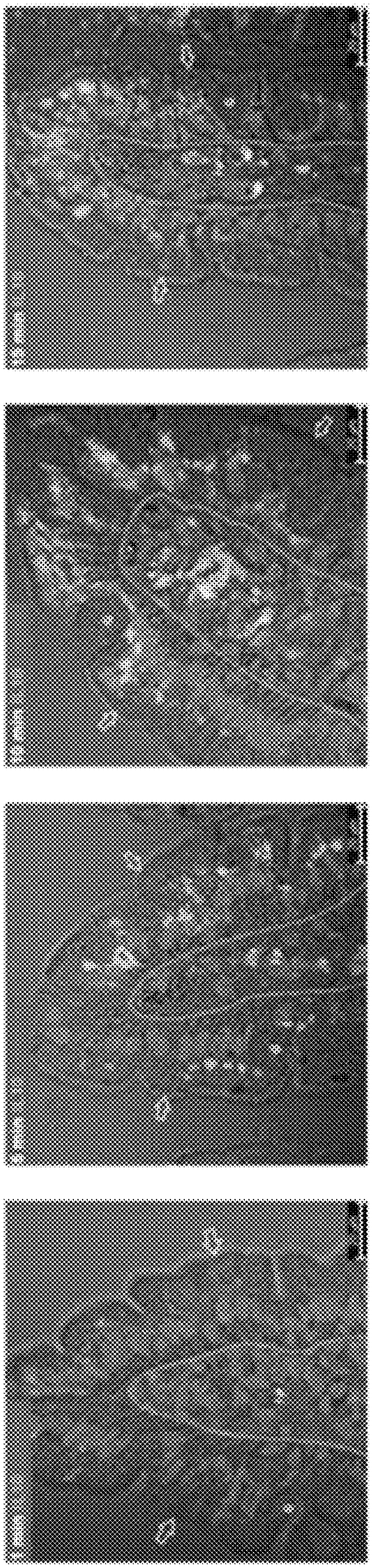

FIG. 133 illustrates no redistribution or co-localization of LAMP1 within enterocytes but extensive co-localization within cells of lamina propria in a time course following intraluminal injection of an IL-10 delivery construct into rat jejunum.

Figure 134:
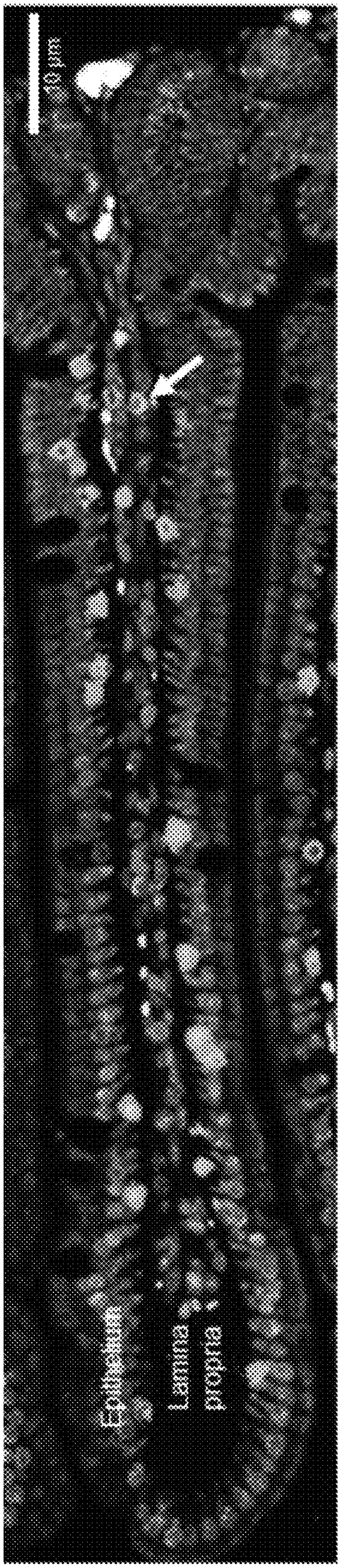

FIG. 134 illustrates localization of T cells (CDC3+) and pSTAT3+ cells in mouse intestinal tissue. A pSTAT3+ CDC3+ cell is indicated by a white arrow.

Figure 135:
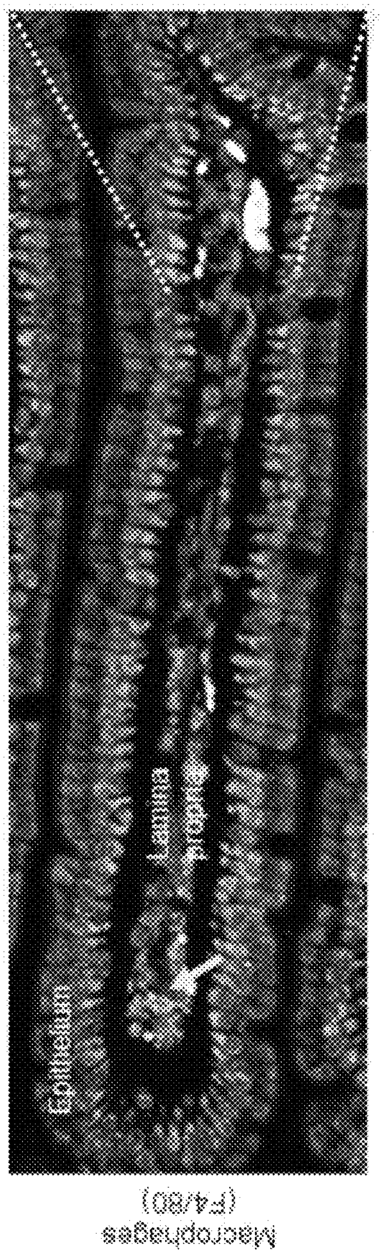

FIG. 135 illustrates localization of macrophages (F4/80+) and pSTAT3+ cells in mouse intestinal tissue. A pSTAT3+ F4/80+ cell is indicated by a yellow arrow.

Figure 136:
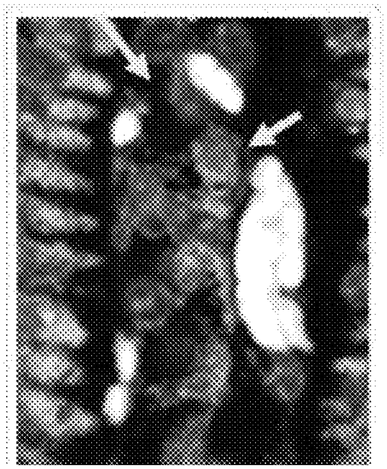

FIG. 136 illustrates higher magnification of an area of FIG. 135. pSTAT3+F4/80+ cells are indicated by yellow arrows.

Figure 137:
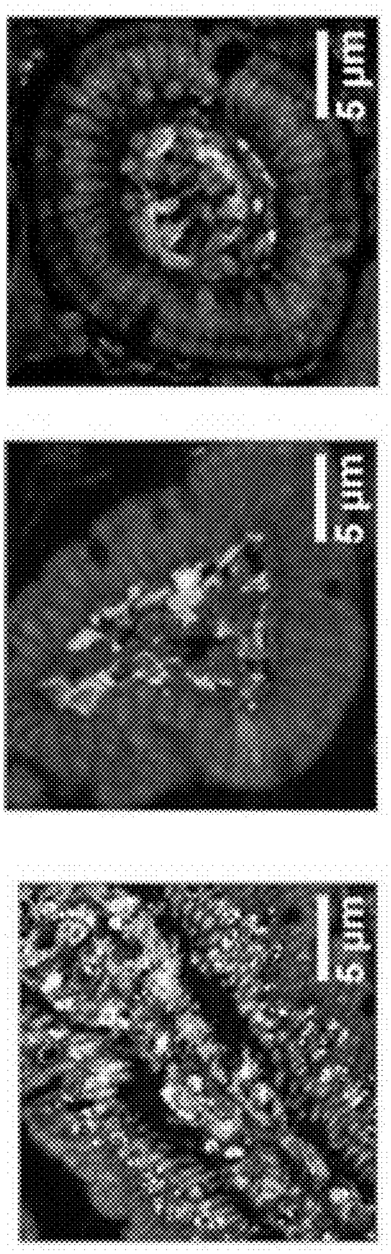

FIG. 137 illustrates additional images of pSTAT3+F4/80+ intestinal cells.

Figure 138:
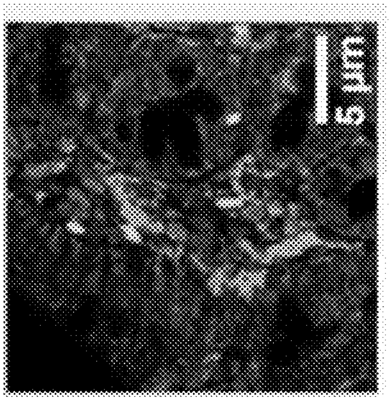

FIG. 138 illustrates an image of pSTAT3+F4/80+ colon cells.

Figure 139:
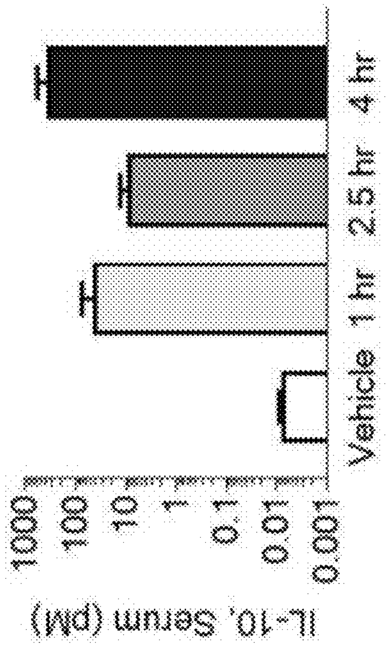

FIG. 139 illustrates concentration of hIL-10 in mouse serum over a time course following oral gavage of 10 mg/kg of an IL-10 delivery construct.

Figure 140:
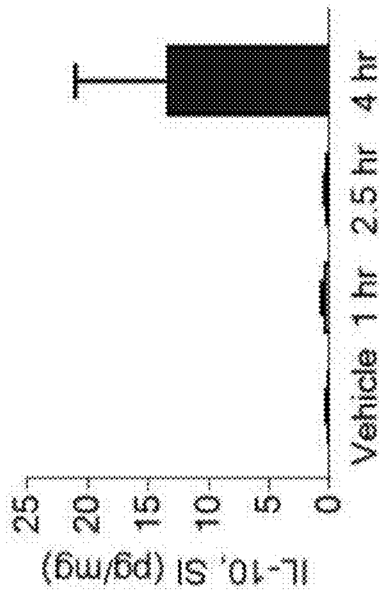

FIG. 140 illustrates concentration of hIL-10 in mouse distal small intestinal tissue over a time course following oral gavage of 10 mg/kg of an IL-10 delivery construct.

Figure 141:
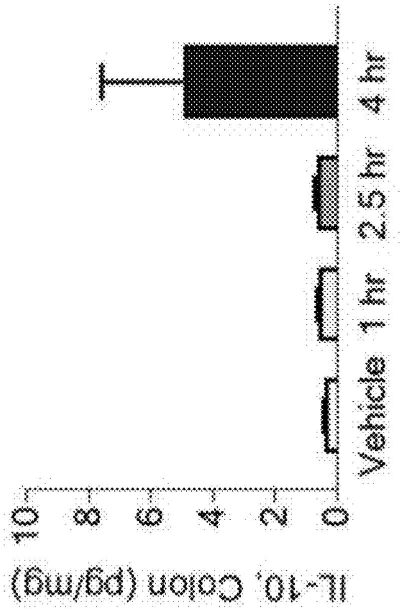

FIG. 141 illustrates concentration of hIL-10 in mouse colonic intestinal tissue over a time course following oral gavage of 10 mg/kg of an IL-10 delivery construct.

Figure 142:
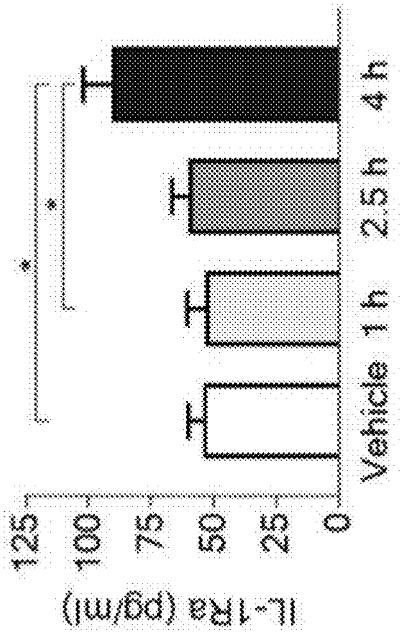

FIG. 142 illustrates concentration of IL-1Ra in mouse serum over a time course following oral gavage of 10 mg/kg of an IL-10 delivery construct.

Figure 143:
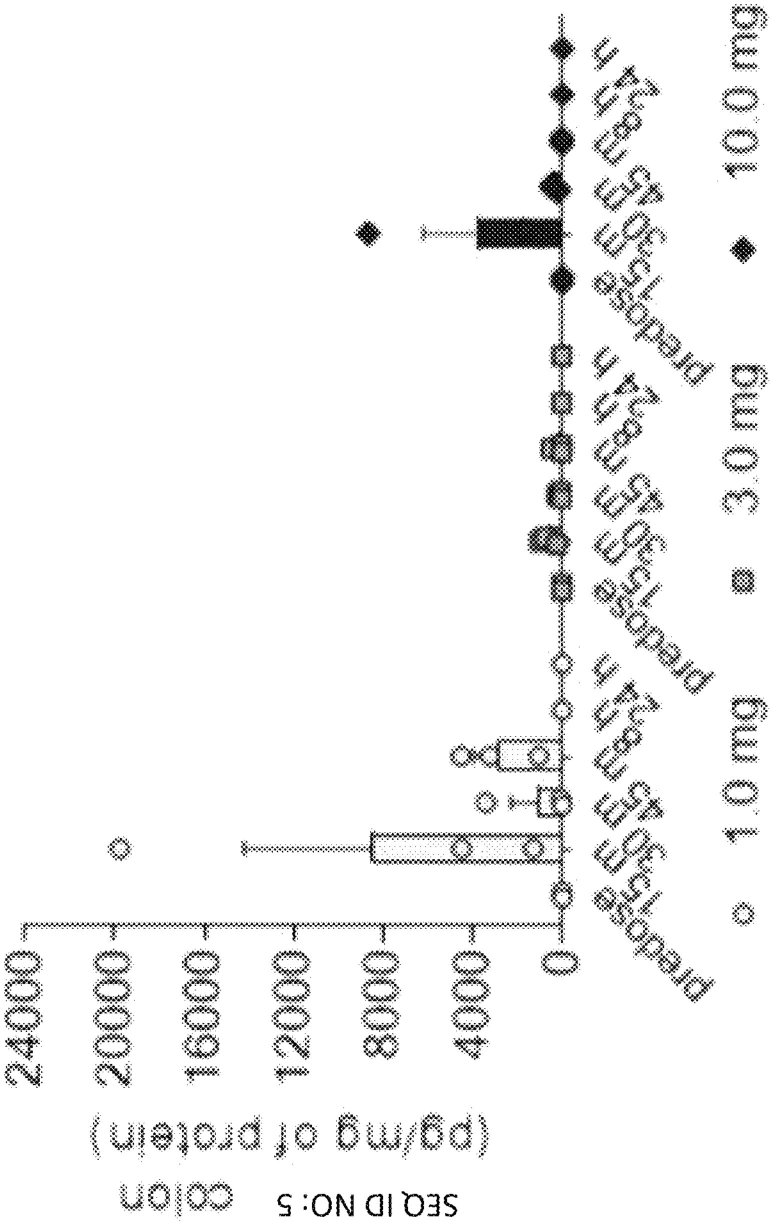

FIG. 143 illustrates concentration of the IL-10 delivery construct in a snip biopsy of colonic tissue following intracolonic spray with the indicated dose of the IL-10 delivery construct.

Figure 144:
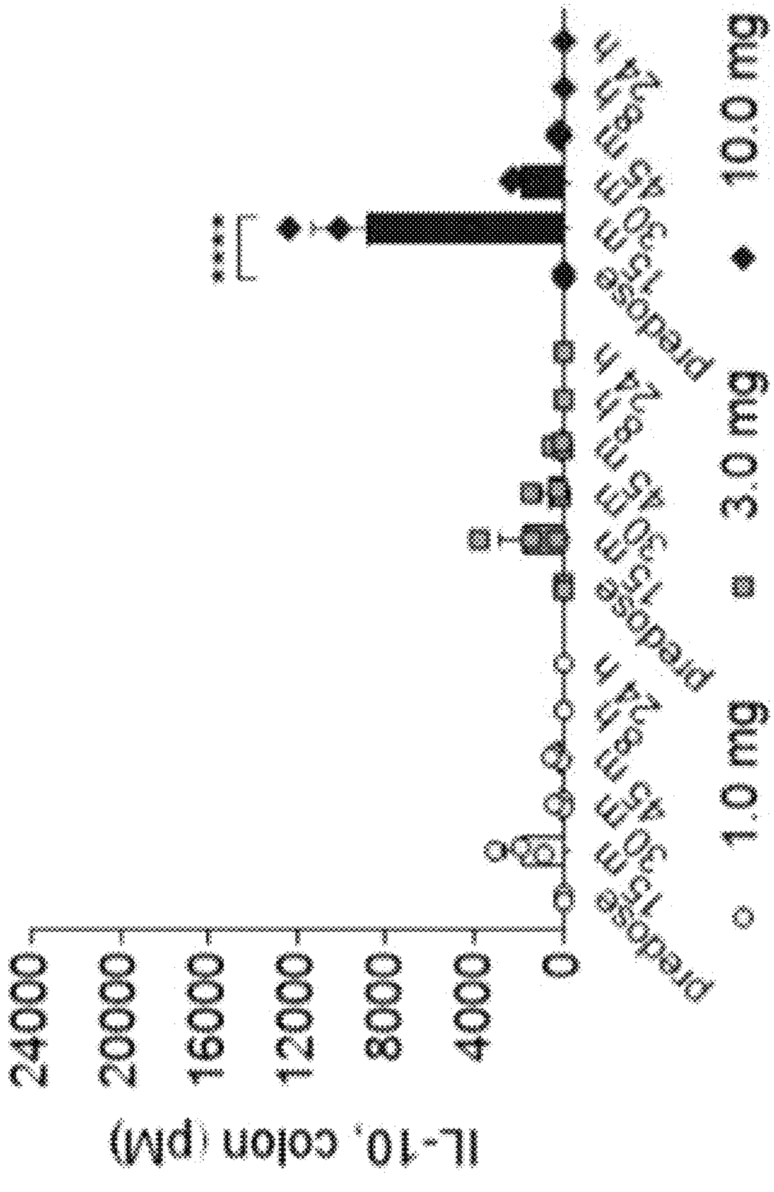

FIG. 144 illustrates concentration of IL-10 in a snip biopsy of colonic tissue following intracolonic spray with the indicated dose of the IL-10 delivery construct.

Figure 145:
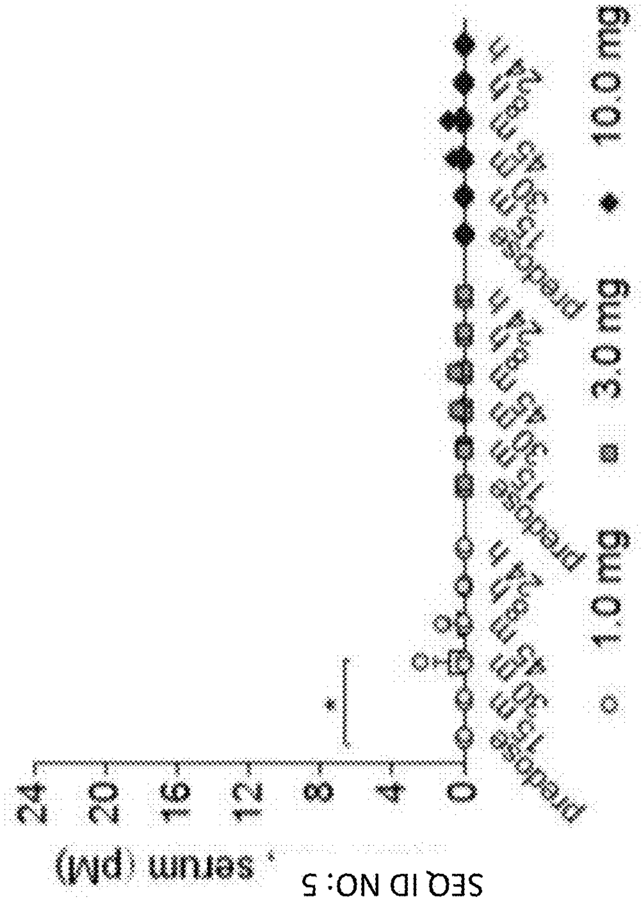

FIG. 145 illustrates the serum concentration of the IL-10 delivery construct following intracolonic spray with the indicated dose of the IL-10 delivery construct.

Figure 146:
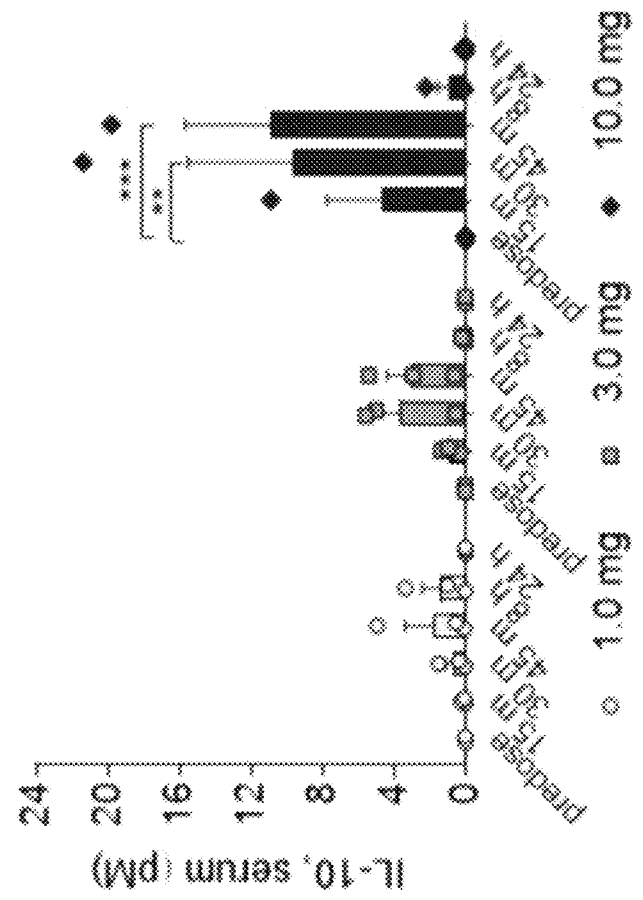

FIG. 146 illustrates the serum concentration of IL-10 following intracolonic spray with the indicated dose of the IL-10 delivery construct.

Figure 147:
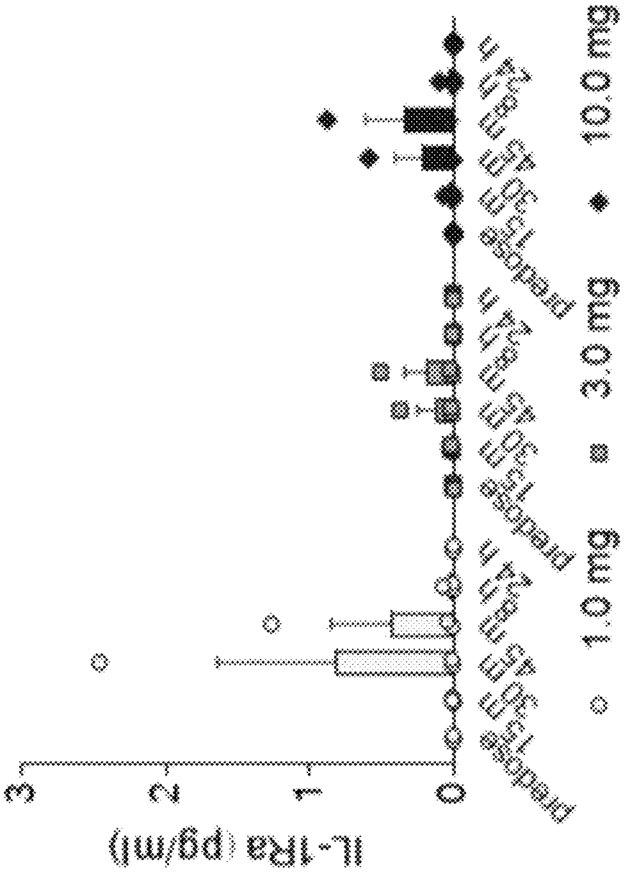

FIG. 147 illustrates the serum concentration of IL-1Ra following intracolonic spray with the indicated dose of the IL-10 delivery construct.

Figure 148:
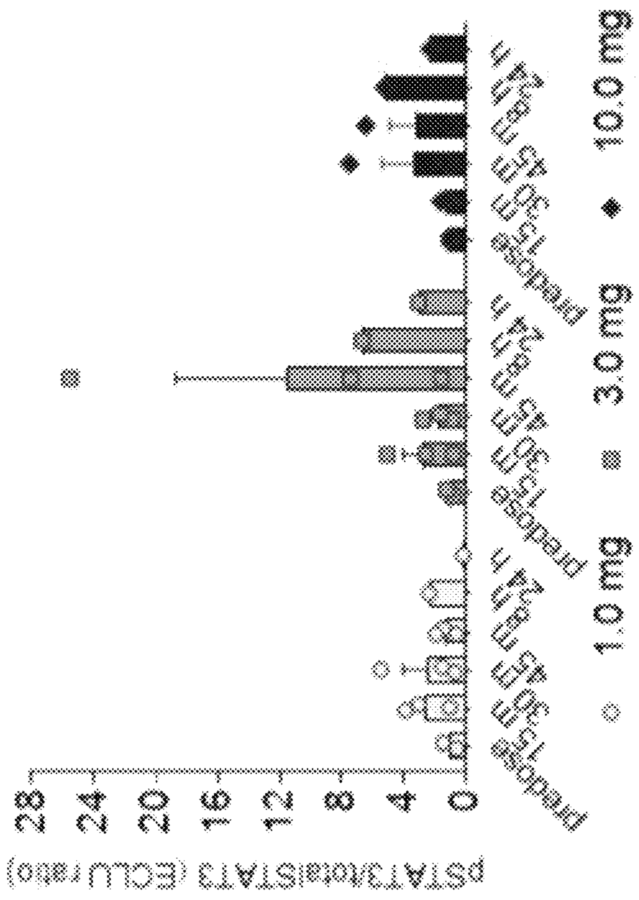

FIG. 148 illustrates the ratio of pSTAT3 relative to total STAT3 following intracolonic spray with the indicated dose of the IL-10 delivery construct.

Figure 149:
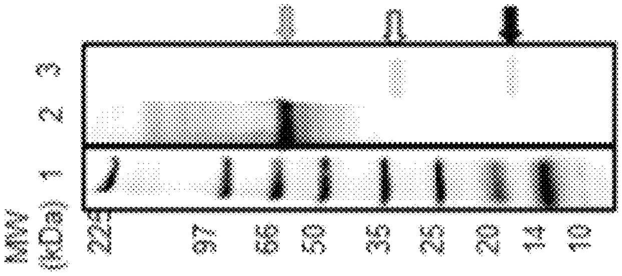

FIG. 149 illustrates a western blot probed for the human IL-10 (hIL-10) component of the IL-10 delivery construct of SEQ ID NO. 5 (lane 2) and commercial rhIL-10 showing monomeric (arrow) and dimeric (double arrow) forms (lane 3). Lane 1 contains molecular weight standards.

Figure 150:
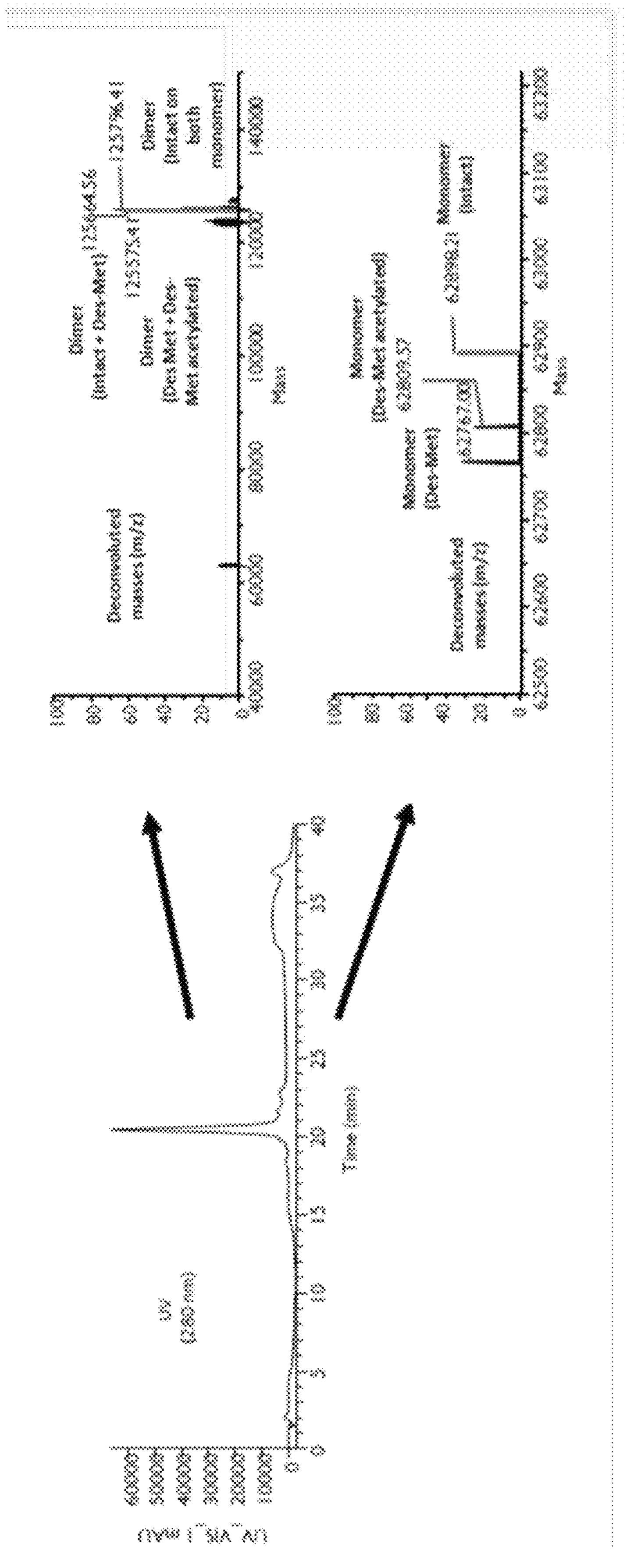

FIG. 150 illustrates the results of reversed-phase chromatography followed by mass spectrometry on the IL-10 delivery construct of SEQ ID NO. 5. Masses corresponding to both the dimer and monomer forms were observed.

DETAILED DESCRIPTION OF THE DISCLOSURE

IL-10 is an anti-inflammatory cytokine which can limit the damage to tissues caused by infections or inflammation, making IL-10 an attractive protein for therapeutic drug development. A fusion protein comprising IL-10 and a carrier, referred to herein as an IL-10 delivery construct, can be formulated into a form suitable for oral administration, such as a tablet or a capsule. Further, these tablets or capsules can be formulated in such a way as to substantially maintain the structural integrity of the IL-10 delivery construct dimers. Additionally, enteric coatings around these oral formulations can contribute to a distinct dissolution profile of the IL-10 delivery construct. Administration to an individual of such oral formulations can be characterized by a distinct pharmacodynamic (PD) and pharmacokinetic (PK) response in the individual.

IL-10 is considered a master regulator of the innate and adaptive immune system, as it is thought to inhibit not only the inflammasome but also many inflammatory events found to be associated with disease including macrophage activation and secretion of IL-1, IL-6, TNF alpha, MMP-1/2 while reducing systemic signs of inflammation and development of T regulatory cells. There is a need for combination therapies that can be used with TNF alpha inhibitors. Providing an IL-10 delivery construct in addition to the TNF alpha inhibitor may be efficacious and achieve better patient outcomes.

The below terms are discussed to illustrate meanings of the terms as used in this specification, in addition to the understanding of these terms by those of skill in the art. As used herein and in the appended claims, the singular forms "a," "an," and, "the" include plural referents unless the context clearly dictates otherwise. It is further noted that the claims can be drafted to exclude any optional element. As such, this statement is intended to serve as antecedent basis for use of such exclusive terminology as "solely," "only," and the like in connection with the recitation of claim elements, or use of a "negative" limitation.

Certain ranges or numbers are presented herein with numerical values being preceded by the term "about." The term "about" is used herein to mean plus or minus 1%, 2%, 3%, 4%, or 5% of the number that the term refers to. As used herein, the terms "subject" and "individual," are used interchangeably and can be any animal, including mammals (e.g., a human or non-human animal).

As used herein, the terms "treat," "treating" or "treatment," and other grammatical equivalents, include alleviating, abating or ameliorating one or more symptoms of a disease or condition, ameliorating, preventing or reducing the appearance, severity or frequency of one or more additional symptoms of a disease or condition, ameliorating or preventing the underlying causes of one or more symptoms of a disease or condition, inhibiting the disease or condition, such as, for example, arresting the development of the disease or condition, relieving the disease or condition, causing regression of the disease or condition, relieving a condition caused by the disease or condition, or inhibiting the symptoms of the disease or condition either prophylactically and/or therapeutically.

As described herein, the term "percent (%) sequence identity," and terms related thereto, in the context of amino acid sequences or nucleic acid sequences, is the percentage of amino acid residues or nucleic acid residues in a candidate sequence that are identical with the amino acid residues or nucleic acid residues, respectively, in a selected sequence, after aligning the sequences and introducing gaps, if necessary, to achieve the maximum percent sequence identity, and not considering any conservative substitutions as part of the sequence identity. Alignment for purposes of determining percent amino acid sequence identity or percent nucleic acid identity can be achieved in various ways that are within the skill in the art, for instance, using publicly available computer software such as Clustal Omega, BLAST, BLAST-2, ALIGN, ALIGN-2 or Megalign (DNASTAR) software, with BLAST being the alignment algorithm of preference. Those skilled in the art can determine appropriate parameters for measuring alignment, including any algorithms needed to achieve maximal alignment over the full-length of the sequences being compared, although for simplicity it maybe preferred to use default parameters.

Interleukin-10 (IL-10) and IL-10 Delivery Constructs

The present disclosure contemplates compositions and methods for delivery of IL-10 to a subject. As previously described, IL-10 is an anti-inflammatory cytokine which can limit the damage to tissues caused by infections or inflammation, making IL-10 an attractive protein for therapeutic drug development. Human IL-10 exists in solution primarily as a homodimer, where two subunits of IL-10 are non-covalently associated and each subunit contains two intra-chain disulfide bonds. Disruption of the dimer structure, such as by reduction or sulfitolysis of these disulfide bonds, can cause the subunits to dissociate to produce monomers of IL-10 or aggregates thereof, which can lack the biological activity of the dimers. Biological activity associated with IL-10 in a dimer form can comprise induction of pro-inflammatory cytokines, such as, tumor necrosis factor alpha (TNF$\alpha$), interleukin-1$\beta$ (IL-1$\beta$), interleukin-12 (IL-12), and interleukin-6 (IL-6). Biological activity associated with IL-10 in a dimer form can comprise downregulation of the expression of Th cytokines, MHC class II antigens, and co-stimulatory molecules on macrophages; enhancing B cell survival, proliferation, and antibody production; blocking of NF-$\kappa$B activity; and regulating the JAK-STAT pathway.

Contemplated herein are formulations comprising IL-10, in which a high degree of the IL-10 is maintained in dimer form. Further contemplated herein are refolding solutions and methods for improved refolding efficiency of IL-10-containing constructs, as well as subsequent purification methods to further produce high levels of dimer that can be present in a dry (e.g., lyophilized) drug substance as well as a final oral formulation. EXAMPLE 3 contains an exemplary refolding protocol. EXAMPLE 4 contains an exemplary purification protocol. EXAMPLE 5 contains an exemplary lyophilization protocol and resulting dimer content of pre- and post-lyophilized compositions.

Figure 1:
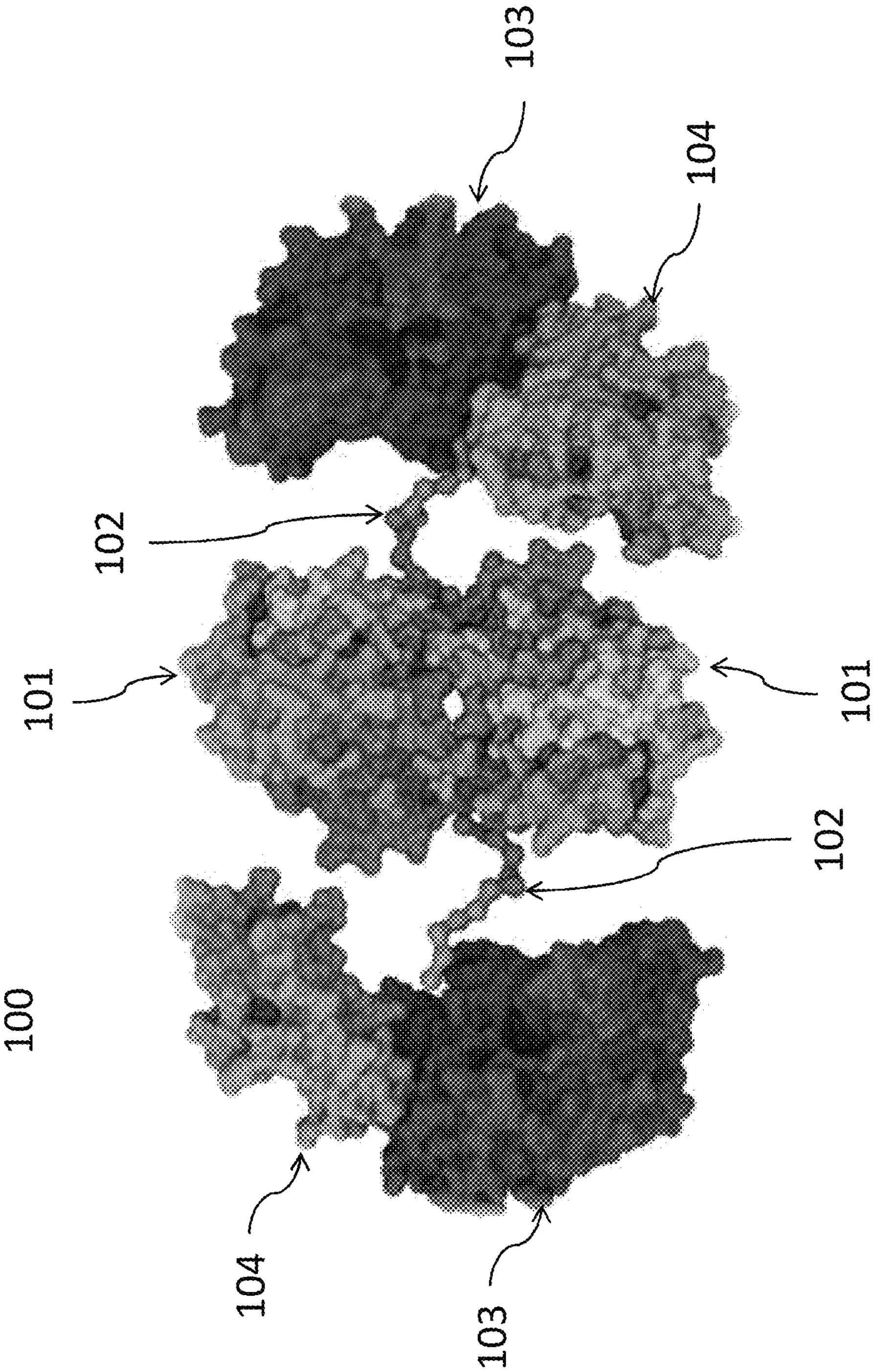
FIG. 1 illustrates the structure of a cholix-IL-10 delivery construct homodimer (a dimer comprising two identical subunits of SEQ ID NO: 5) as determined by small angle X-ray scattering (SAXS).

In some embodiments, an IL-10 molecule is coupled to a carrier that can deliver the IL-10 across a gut epithelial cell, or a polarized epithelial cell. This is referred to as an IL-10 delivery construct. Preferably, the IL-10 that is coupled to the carrier is in a dimer form. In some instance, the dimer is a homodimer. In some instances, the dimer is a heterodimer. In some instances, the heterodimer may comprise a first IL-10 monomer and a variant IL-10 monomer that differs in sequence from the first IL-10 monomer to form a dimeric IL-10. When IL-10 is in a dimer form, either a single monomer or both monomers can be coupled to a carrier. In one embodiment, each IL-10 is independently coupled to a carrier. An IL-10 delivery construct dimer can be illustrated by FIG. 1. The IL-10 delivery construct homodimer 100 can comprise two IL-10 delivery constructs (e.g., SEQ ID NO: 5), each delivery construct comprising an IL-10 101 connected by a spacer 102 to a carrier. The carrier can comprise a binding domain 103 and a translocation domain 104.

The percent dimer in a composition can describe the percentage of the total number of IL-10 delivery constructs in a dimer. For example, where a composition has three copies of an IL-10/carrier fusion protein, two of which form a dimer, 67% of the delivery constructs can be considered to be in dimer form.

IL-10 can be a human IL-10. Human IL-10 can comprise, consist essentially of, or consist of an amino acid sequence of SEQ ID NO: 1 or SEQ ID NO: 2. Variants of IL-10 include those having one or more amino acid substitutions, additions and/or deletions as compared to a reference sequence. Variants of IL-10 may retain the ability to upregulate IL-1Ra in colonic tissue or serum after administration by intracolonic spray in cynomolgus monkeys. In some instances, variants of IL-10 or SEQ ID NO: 1 or SEQ ID NO: 2 are contemplated in the compositions and methods described herein. Variants of IL-10 or SEQ ID NO: 1 or SEQ ID NO: 2 can be an amino acid sequence having at least 80%, 85%, 90%, 95%, 98% or 99%% sequence identity thereto or a fragment thereof. Variants of IL-10 may comprise amino acid substitutions at one or more of N36, N36, D73, I87, N110, N115, K117, R128, F129, and N172 relative to SEQ ID NO: 1. Variants of IL-10 may comprise one or more amino acid substitutions such as N36Y, N36I, D73V, 187M, N110I, N115K, K117N, R128W, F129L, and N172H relative to SEQ ID NO: 1. In some cases, an IL-10 variant may comprise N36Y, N110I, K117N, and N172H substitutions. In some cases, an IL-10 variant may comprise N36Y, D73V, I87M, N101I, N115K, and R128W relative to SEQ ID NO: 1. In some cases, an IL-10 variant may comprise N36I, N110I, K117N, and F129L relative to SEQ ID NO: 1.

A carrier can be a protein or another type of molecule capable of transporting the heterologous payload across or into an epithelium (e.g., a polarized gut epithelium of a subject, such as a human). Such transport can include transcytosis. The transcytosis process may involve interaction(s) of the carrier with one or more receptor(s) and/or protein(s) on the apical and/or basal surface(s) as well as inside a cell of the epithelium (e.g., a polarized gut epithelial cell). The carrier can be capable of transporting a heterologous payload, such IL-10, across an epithelium without impairing the epithelium, the carrier, and/or the biological and/or therapeutic function of the payload.

In some embodiments, a carrier herein utilizes an endogenous trafficking pathway to transport a heterologous payload coupled thereto across a polarized epithelial cell. Such carrier can be referred to herein as a transcytosing carrier. In some instances, a carrier herein can utilize an endogenous trafficking pathway to transport a heterologous payload coupled thereto into a polarized epithelial cell. Such carrier can be referred to herein as an endocytosing carrier. Within endocytosing carriers, there can be carriers that deliver a payload coupled thereto into specific regions within the polarized epithelial cells such as an apical compartment, a supranuclear compartment, or a basal compartment.

Any of the carriers herein can transport molecules coupled thereto by interacting and/or co-localizing with one or more endogenous proteins of such epithelium. The one or more endogenous proteins can be receptors or enzymes capable of moving a carrier into or across the epithelial cell. Interacting and/or co-localizing with the one or more endogenous proteins of the epithelial cell can provide a carrier with one or more functions, including endocytosis into the epithelial cell, avoidance of a lysosomal destruction pathway, trafficking from an apical compartment to a basal compartment, and/or exocytosis from the basal membrane of the epithelial cell into a submucosal compartment such as the lamina propria.

A carrier may be derived from a polypeptide secreted by a bacterium. Such a carrier may be derived from a polypeptide secreted from *Vibrio cholerae* or *Pseudomonas aeruginosa*. In some embodiments, the carrier is a cholix polypeptide. In some embodiments, the carrier is a cholix polypeptide secreted by *Vibrio cholerae*, while in other embodiments the cholix polypeptide is variant thereof or is derived from some other species. The cholix polypeptide (e.g., a cholix polypeptide secreted from *Vibrio cholerae* or a variant thereof) can, for example, comprise a sequence of any one of SEQ ID NOS: 20-146 of TABLE 2. TABLE 4 illustrates exemplary carriers by identifying various amino acid residue sequences of such carriers and C-terminal positions that SEQ ID NOs 20-147 can be truncated at. In some embodiments, the cholix polypeptide does not comprise or consist of SEQ ID NO: 126. A cholix polypeptide can include naturally and non-naturally occurring cholix polypeptide sequences, as well as those sequences that have at least about 75%, 80%, 85%, 90%, 95%, 98%, 99%, or 100% sequence identity to a naturally (e.g., SEQ ID NOS: 20-78 or 130-146) or non-naturally (e.g., SEQ ID NO: 3 or 11) occurring cholix polypeptide described herein. A cholix polypeptide can also include endocytosing and/or transcytosing fragments (e.g., N- and/or C-terminal truncations of cholix polypeptide) of naturally or non-naturally occurring cholix polypeptide sequences, wherein such endocytosing and/or transcytosing fragments can have at least about 75%, 80%, 85%, 90%, 95%, 98%, 99%, or 100% sequence identity to any of such naturally or non-naturally occurring cholix polypeptide sequences.

TABLE 3 provides a consensus sequence (SEQ ID NO: 147, FORMULA I) of cholix derived polypeptides that can be used as carriers herein.

For example, a non-naturally occurring cholix polypeptide can include or consist of the amino acid sequence set forth in SEQ ID NO: 3 or SEQ ID NO: 11 (TABLE 1). A cholix polypeptide carrier can be a truncated and/or mutated variant of a full-length cholix polypeptide. Examples of transcytosing carriers can include those having a C-terminal truncation of any one of SEQ ID NOs 3, 11, 20-78, or 130-146, wherein the C-terminal truncation can occur at the C-terminus of the polypeptide at any amino acid position after the C-terminal residue at position 195 (e.g., truncation at any one of positions 195-634 of SEQ ID NOs: 3 or 11). Amino acid positions for truncation can be determined using sequence alignment to consensus sequence SEQ ID NO: 147 or any of reference sequences SEQ ID NO: 3 or 11. TABLE 4 below illustrates amino acid ranges that are included in exemplary carriers and identifies various C-terminal positions at which SEQ ID NOs 3, 11, 20-78 or 130-146 can be truncated. In some instances, transcytosing carriers include those having a C-terminal truncation of any of SEQ ID NOs 3, 11, 20-78, or 130-146.

A carrier can be a truncated version of a longer cholix polypeptide that is not naturally occurring. For example, the carrier can have an amino acids sequences that comprises or consists of amino acid residues 1-206, 1-245, 1-251, 1-266, and 1-386 of SEQ ID NO: 3 or SEQ ID NO: 11. Mutation(s) in the non-naturally occurring variant can include one or more substitution(s), deletion(s), and/or addition(s) relative to a naturally occurring cholix polypeptide. In some embodiments, a carrier herein can comprise a V1L substitution. Stated differently, in some embodiments, the cholix-related carrier has a leucine amino acid at position "1." (Position 1 generally refers to the first amino acid of variants that do not have an N-terminal methionine or the second position in variants that include an N-terminal methionine. In other words, in determining the length of a carrier, an N-terminal methionine, if present, can be ignored.) In some embodiments, carriers comprising the V1L substitution experience reduced or eliminated cleavage of the N-terminal amino acid. In some embodiments, carriers comprising the V1L substitution experience reduced or eliminated acetylation of the N-terminal amino acid. A carrier provided herein can have a reduced (e.g., at least 50% reduced) or ablated ADP ribosylation activity (e.g., ribosylation of elongation factor 2) relative to a naturally-occurring cholix variant. In some embodiments, the carrier can comprise an N-terminal methionine. In other embodiments, no N-terminal methionine is present.

A carrier herein can have a reduced (e.g., at least 50% reduced) or ablated ADP ribosylation activity (e.g., ribosylation of elongation factor 2). A carrier can be a polypeptide derived from cholix or a variant thereof that is further truncated at any one of positions 206 to 633 as compared to a reference sequence, for example SEQ ID NO: 3 or SEQ ID NO: 11. A truncation of a cholix protein (e.g. a truncation of SEQ ID NO: 147 or variant thereof) that has the ability to transport a heterologous payload via transcytosis, such as the IL-10 delivery construct, can be referred to as a functional fragment. Carriers also include variants of any of the above having at least 80%, 85%, 90%, 95%, 98%, or 99% sequence identity to any of the carrier sequences herein. In one instance, a carrier comprises SEQ ID NO: 3. In another instance, a carrier comprises SEQ ID NO: 4. Any of the carriers herein can have a V1L substitution, alone or in combination with an N-terminal methionine. In one instance, a carrier comprises SEQ ID NO: 11. In one instance, a carrier comprises SEQ ID NO: 12. Carriers also include variants of any of the above having at least 80%, 85%, 90%, 95%, 98%, or 99% sequence identity to any of the sequences herein.

A carrier can be coupled to the IL-10 covalently or non-covalently, directly or indirectly. When an IL-10 is coupled to a carrier covalently, it may be coupled to the carrier directly or via a spacer. The IL-10 can be coupled to the C-terminus or the N-terminus of the carrier. When a spacer is used to couple the IL-10 to the carrier, a spacer can include one or more amino acids. Examples of spacers contemplated herein include oligopeptide sequences such as S, $(GS)_x$, $(GGS)_x$, $(GGGS)_x$, (SEQ ID NO: 7) $(GGGGS)_x$ (SEQ ID NO: 8), or $(GGGGGS)_x$ (SEQ ID NO: 9), wherein x=1, 2, 3, 4, 5, 6, 7, 8, 9, 10, 11, 12, 13, 14, or 15. In some cases, a spacer does not include an S residue adjacent to the IL-10 sequence, e.g., SEQ ID NO: 6 (GGGGSGGGGSGGGG).

The carrier and/or the IL-10 can further comprise one or more modifications on their N-terminus and/or C-terminus. Such modifications can include an N-terminal methionine residue or other known residue for an expression in a heterologous system.

The IL-10 delivery construct can co-localize with a cell in the lamina propria expressing CD3. The cell expressing CD3 can be a lymphocyte. The lymphocyte can be a T cell. In some embodiments, the IL-10 delivery construct does not co-localize with a cell in the lamina propria expressing CD11c (e.g. dendritic cells), CD19 (e.g. B-lymphocytes), or CD34 (e.g. endothelia). The IL-10 delivery construct can co-localize with a macrophage in the lamina propria. Co-localization of the IL-10 delivery construct with a cell can comprise interaction or binding of the IL-10 delivery construct with a receptor on the surface of the cell. The carrier or the IL-10 of the IL-10 delivery construct can interact or bind with the receptor.

In some embodiments, the IL-10 delivery construct comprises, consists essentially of, or consists of the amino acid sequence of SEQ ID NO: 5. The IL-10 delivery construct can have at least 80%, 85%, 90%, 92%, 94%, 95%, 96%, 97%, 98%, 99%, or 100% sequence identity to an amino acid sequence set forth in SEQ ID NO: 5. In some embodiments, the IL-10 delivery construct comprises, consists essentially of, or consists of the amino acid sequence of SEQ ID NO: 13. The IL-10 delivery construct can have at least 80%, 85%, 90%, 92%, 94%, 95%, 96%, 97%, 98%, 99%, or 100% sequence identity to an amino acid sequence set forth in SEQ ID NO: 13. Expression and purification of IL-10, optionally with one or more carrier and one or more spacers, as provided herein, can result in a substantially increased concentration of a dimerized IL-10 delivery construct. In one example, expression and purification of SEQ ID NO: 5 can result in a composition comprising greater than 80%, 81%, 82%, 83%, 84%, 85%, 86%, 87%, 88%, 89%, 90%, 91%, 92%, 93%, 94%, 95%, 96%, 97%, 98%, or 99% of the IL-10 is in a dimer form. In another example, expression and purification of SEQ ID NO: 13 can result in a composition comprising greater than 80%, 81%, 82%, 83%, 84%, 85%, 86%, 87%, 88%, 89%, 90%, 91%, 92%, 93%, 94%, 95%, 96%, 97%, 98%, or 99% of the IL-10 is in a dimer form. Such IL-10 can be a M-hIL10 or M-cholix$^{386}$-IL-10, wherein the hIL-10 or cholix$^{386}$-IL-10 comprises an N-terminal methionine (M). Alternatively, from 85% to 90%, from 85% to 92%, or from 85% to 95% of the IL-10 is in a dimer form.

In some embodiments, from 2% to 5% of the IL-10 is in an aggregate form. In some embodiments, no more than 2%, 3%, 4%, or 5% of the IL-10 is in an aggregate form. In some embodiments, from 5% to 7% or 6% to 7% of the IL-10 is in a monomer form. In some embodiments, no more than 5%, 6%, 7%, or 8% of the IL-10 is in a monomer form.

Figure 34:
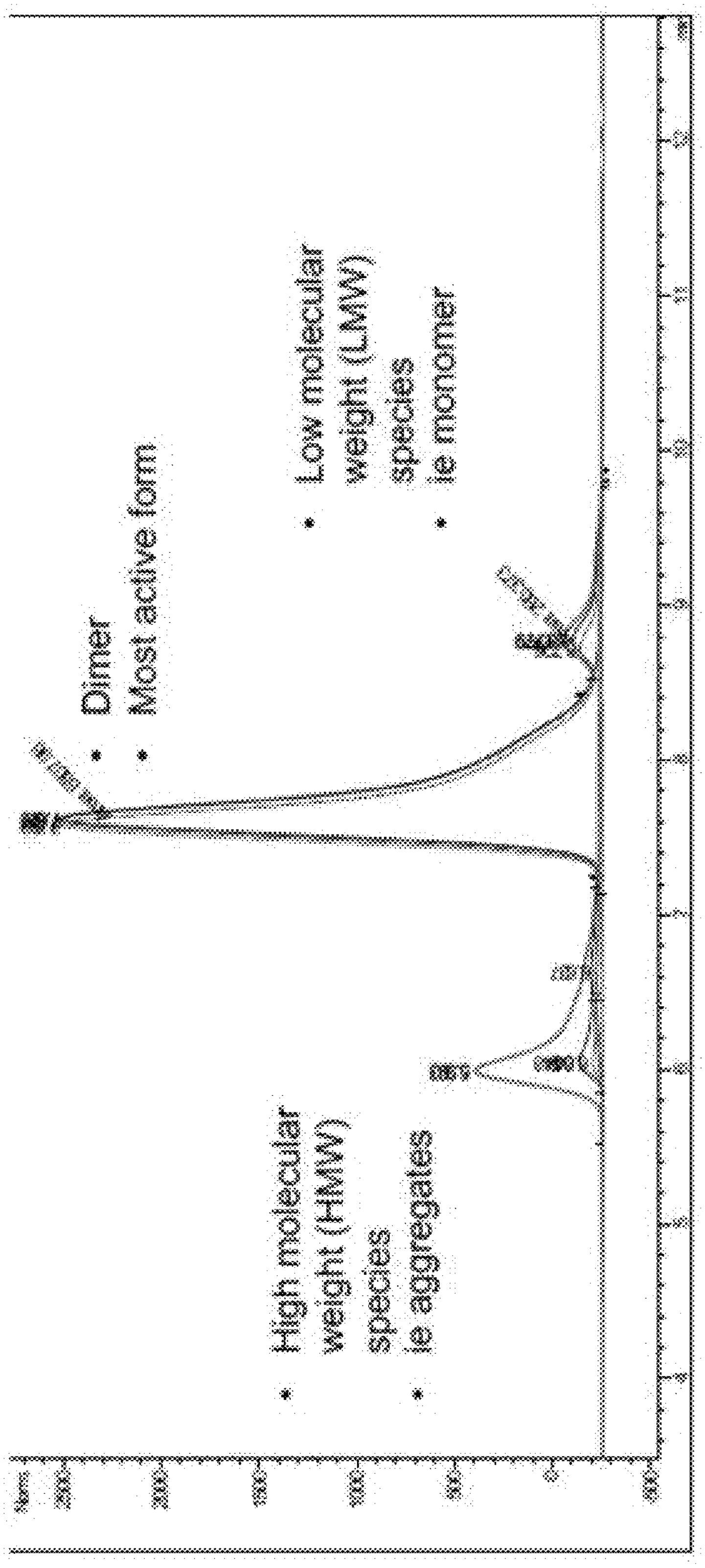
FIG. 34 illustrates a size exclusion chromatogram (SEC) identifying peaks representing target construct (SEQ ID NO: 5) dimer, aggregate, and monomer.

Size exclusion chromatography (SE-HPLC) can be used to characterize the size distribution of the IL-10 delivery construct. The percentage of IL-10 delivery construct found in dimer, monomer, and aggregate forms in a liquid composition or a lyophilized composition if reconstituted in a liquid can be determined by SEC-HPLC (FIG. 34).

Further described herein, are non-naturally occurring nucleic acids comprising, consisting essentially of, or consisting of a nucleic acid sequence set forth in SEQ ID NO:10, or a nucleic acid sequence at least 90%, at least 92%, at least 95%, at least 98%, or at least 99% sequence identity to SEQ ID NO: 10. The nucleic acid can be codon optimized. The nucleic acid can be encoded by a vector. The vector can be a plasmid or a viral vector. The viral vector can be a lentivirus, an adenovirus, an adeno-associated virus (AAV), a retrovirus, or a herpes simplex virus. The vector can be replication competent or a replication incompetent. The vector can be an integrating vector or a non-integrating vector. A cell can be transformed with any of the vectors described herein. The cell can be a bacterial cell. The bacterial cell can be an *Escherichia coli* cell. The cell can be a yeast cell. The yeast cell can be a *Saccharomyces cerevisiae* cell.

TABLE 1

Sequences

| SEQ ID NO: | Description | Sequence |
|---|---|---|
| SEQ ID NO: 1 | IL-10 | MHSSALLCCLVLLTGVRASPGQGTQSENSCTHFPGNLPNML<br>RDLRDAFSRVKTFFQMKDQLDNLLLKESLLEDFKGYLGCQ<br>ALSEMIQFYLEEVMPQAENQDPDIKAHVNSLGENLKTLRLR<br>LRRCHRFLPCENKSKAVEQVKNAFNKLQEKGIYKAMSEFDI<br>FINYIEAYMTMKIRN |
| SEQ ID NO: 2 | IL-10, secreted active form | SPGQGTQSENSCTHFPGNLPNMLRDLRDAFSRVKTFFQMKD<br>QLDNLLLKESLLEDFKGYLGCQALSEMIQFYLEEVMPQAEN<br>QDPDIKAHVNSLGENLKTLRLRLRRCHRFLPCENKSKAVEQ<br>VKNAFNKLQEKGIYKAMSEFDIFINYIEAYMTMKIRN |
| SEQ ID NO: 3 | Non-naturally occurring cholix variant | VEEALNIFDECRSPCSLTPEPGKPIQSKLSIPSDVVLDEGVLY<br>YSMTINDEQNDIKDEDKGESIITIGEFATVRATRHYVNQDAP<br>FGVIHLDITTENGTKTYSYNRKEGEFAINWLVPIGEDSPASIK<br>ISVDELDQQRNIIEVPKLYSIDLDNQTLEQWKTQGNVSFSVT<br>RPEHNIAISWPSVSYKAAQKEGSRHKRWAHWHTGLALCWL<br>VPMDAIYNYITQQNCTLGDNWFGGSYETVAGTPKVITVKQ<br>GIEQKPVEQRIHFSKGNAMSALAAHRVCGVPLETLARSRKP<br>RDLTDDLSCAYQAQNIVSLFVATRILFSHLDSVFTLNLDEQE<br>PEVAERLSDLRRINENNPGMVTQVLTVARQIYNDYVTHHPG<br>LTPEQTSAGAQAADILSLFCPDADKSCVASNNDQANINIESR<br>SGRSYLPENRAVITPQGVTNWTYQELEATHQALTREGYVFV<br>GYHGTNHVAAQTIVNRIAPVPRGNNTENEEKWGGLYVATH<br>AEVAHGYARIKEGTGEYGLPTRAERDARGVMLRVYIPRASL<br>ERFYRTNTPLENAEEHITQVIGHSLPLRNEAFTGPESAGGED<br>ETVIGWDMAIHAVAIPSTIPGNAYEELAIDEEAVAKEQSISTK<br>PPYKERKDELK |
| SEQ ID NO: 4 | Non-naturally occurring cholix variant (cholix$^{386}$) | VEEALNIFDECRSPCSLTPEPGKPIQSKLSIPSDVVLDEGVLY<br>YSMTINDEQNDIKDEDKGESIITIGEFATVRATRHYVNQDAP<br>FGVIHLDITTENGTKTYSYNRKEGEFAINWLVPIGEDSPASIK<br>ISVDELDQQRNIIEVPKLYSIDLDNQTLEQWKTQGNVSFSVT<br>RPEHNIAISWPSVSYKAAQKEGSRHKRWAHWHTGLALCWL<br>VPMDAIYNYITQQNCTLGDNWFGGSYETVAGTPKVITVKQ<br>GIEQKPVEQRIHFSKGNAMSALAAHRVCGVPLETLARSRKP<br>RDLTDDLSCAYQAQNIVSLFVATRILFSHLDSVFTLNLDEQE<br>PEVAERLSDLRRINENNPGMVTQVLTVARQIYNDYVTHHPG<br>LTPEQTSAGAQA |
| SEQ ID NO: 5 | IL-10 delivery construct | MVEEALNIFDECRSPCSLTPEPGKPIQSKLSIPSDVVLDEGVL<br>YYSMTINDEQNDIKDEDKGESIITIGEFATVRATRHYVNQDA<br>PFGVIHLDITTENGTKTYSYNRKEGEFAINWLVPIGEDSPASI<br>KISVDELDQQRNIIEVPKLYSIDLDNQTLEQWKTQGNVSFSV<br>TRPEHNIAISWPSVSYKAAQKEGSRHKRWAHWHTGLALCW<br>LVPMDAIYNYITQQNCTLGDNWFGGSYETVAGTPKVITVKQ<br>GIEQKPVEQRIHFSKGNAMSALAAHRVCGVPLETLARSRKP<br>RDLTDDLSCAYQAQNIVSLFVATRILFSHLDSVFTLNLDEQE<br>PEVAERLSDLRRINENNPGMVTQVLTVARQIYNDYVTHHPG<br>LTPEQTSAGAQAGGGGSGGGGSGGGGSPGQGTQSENSCTH<br>FPGNLPNMLRDLRDAFSRVKTFFQMKDQLDNLLLKESLLED<br>FKGYLGCQALSEMIQFYLEEVMPQAENQDPDIKAHVNSLGE<br>NLKTLRLRLRRCHRFLPCENKSKAVEQVKNAFNKLQEKGIY<br>KAMSEFDIFINYIEAYMTMKIRN |
| SEQ ID NO: 6 | Spacer | GGGGSGGGGSGGGG |
| SEQ ID NO: 10 | DNA sequence encoding IL-10 delivery construct | ATGGTAGAAGAAGCGCTGAATATTTTTGACGAGTGTCGT<br>AGCCCGTGTAGCCTGACTCCGGAACCGGGCAAGCCGATT<br>CAGTCCAAACTGTCTATCCCGAGCGACGTTGTGCTGGATG<br>AGGGCGTGTTGTATTACAGCATGACGATCAATGATGAGC<br>AAAACGACATCAAAGACGAAGATAAGGGTGAGTCTATTA<br>TCACCATTGGCGAGTTTGCGACGGTGCGTGCAACGCGCC<br>ATTACGTGAATCAAGACGCGCCGTTTGGTGTCATTCACCT<br>GGATATCACGACCGAAAATGGCACGAAAACCTATTCGTA<br>TAATCGCAAAGAGGGCGAGTTCGCGATCAACTGGCTGGT<br>TCCGATCGGTGAGGATAGCCCGGCGAGCATCAAGATCAG<br>CGTTGATGAACTGGATCAGCAGCGCAACATTATTGAAGT<br>CCCGAAGTTGTATAGCATCGACCTGGATAATCAGACCCT<br>GGAGCAGTGGAAAACCCAGGGTAACGTTAGCTTCTCCGT<br>GACCCGTCCGGAGCACAACATTGCCATTAGCTGGCCGAG |

TABLE 1-continued

| Sequences | | |
|---|---|---|
| SEQ ID NO: | Description | Sequence |
| | | CGTTAGCTACAAAGCCGCACAGAAAGAGGGTTCCCGCCA<br>CAAGCGTTGGGCTCATTGGCATACCGGTTTGGCGCTGTGT<br>TGGCTGGTGCCGATGGATGCGATCTATAACTACATCACGC<br>AGCAAAATTGCACGCTGGGTGACAATTGGTTCGGTGGCA<br>GCTACGAGACTGTGGCGGGTACCCCTAAGGTTATTACCGT<br>CAAACAGGGTATTGAGCAAAAGCCTGTCGAGCAGCGTAT<br>CCACTTTAGCAAGGGTAACGCCATGTCTGCTCTGGCGGCT<br>CATAGAGTTTGCGGCGTTCCGCTGGAGACTCTGGCCCGTT<br>CCCGCAAGCCGCGTGACCTGACCGATGACCTGAGCTGCG<br>CGTATCAAGCGCAAAACATTGTTAGCTTATTCGTTGCGAC<br>GCGCATTTTGTTTTCGCACCTGGATAGCGTGTTCACGCTG<br>AACCTGGATGAACAGGAACCAGAAGTGGCAGAGCGTCTG<br>TCAGATCTGCGTCGTATCAACGAAAACAACCCGGGCATG<br>GTTACCCAGGTCCTTACGGTTGCACGCCAGATTTACAATG<br>ATTACGTGACCCATCACCCGGGTCTGACCCCAGAACAAA<br>CCAGCGCAGGCGCACAAGCGGGTGGCGGTGGTTCCGGTG<br>GCGGTGGTAGCGGTGGCGGTGGTAGCCCTGGTCAAGGCA<br>CCCAATCCGAGAATAGCTGCACGCATTTTCCAGGCAATCT<br>GCCGAATATGCTGCGTGACCTCCGCGACGCGTTCTCTCGT<br>GTTAAGACCTTTTTTCAGATGAAAGACCAGCTGGACAATC<br>TGCTGCTGAAAGAATCCCTGCTGGAAGATTTCAAAGGCT<br>ATCTGGGTTGCCAGGCCCTGAGCGAGATGATCCAATTCTA<br>CTTGGAAGAGGTCATGCCGCAGGCCGAAAATCAAGACCC<br>GGACATCAAGGCACACGTGAACAGCTTGGGCGAAAACCT<br>GAAAACCCTGCGTTTGCGCCTGCGTCGTTGTCACCGTTTC<br>CTGCCGTGCGAGAATAAGAGCAAAGCCGTCGAACAAGTC<br>AAAAATGCATTCAACAAGCTGCAAGAGAAAGGTATCTAC<br>AAGGCTATGAGCGAGTTTGACATTTTCATTAACTACATTG<br>AAGCGTACATGACCATGAAGATCCGTAAC |
| SEQ ID NO: 11 | Non-naturally occurring cholix variant (V1L) | LEEALNIFDECRSPCSLTPEPGKPIQSKLSIPSDVVLDEGVLY<br>YSMTINDEQNDIKDEDKGESIITIGEFATVRATRHYVNQDAP<br>FGVIHLDITTENGTKTYSYNRKEGEFAINWLVPIGEDSPASIK<br>ISVDELDQQRNIIEVPKLYSIDLDNQTLEQWKTQGNVSFSVT<br>RPEHNIAISWPSVSYKAAQKEGSRHKRWAHWHTGLALCWL<br>VPMDAIYNYITQQNCTLGDNWFGGSYETVAGTPKVITVKQ<br>GIEQKPVEQRIHFSKGNAMSALAAHRVCGVPLETLARSRKP<br>RDLTDDLSCAYQAQNIVSLFVATRILFSHLDSVFTLNLDEQE<br>PEVAERLSDLRRINENNPGMVTQVLTVARQIYNDYVTHHPG<br>LTPEQTSAGAQAADILSLFCPDADKSCVASNNDQANINIESR<br>SGRSYLPENRAVITPQGVTNWTYQELEATHQALTREGYVFV<br>GYHGTNHVAAQTIVNRIAPVPRGNNTENEEKWGGLYVATH<br>AEVAHGYARIKEGTGEYGLPTRAERDARGVMLRVYIPRASL<br>ERFYRTNTPLENAEEHITQVIGHSLPLRNEAFTGPESAGGED<br>ETVIGWDMAIHAVAIPSTIPGNAYEELAIDEEAVAKEQSISTK<br>PPYKERKDELK |
| SEQ ID NO: 12 | Non-naturally occurring cholix variant (cholix$^{386}$) (V1L) | LEEALNIFDECRSPCSLTPEPGKPIQSKLSIPSDVVLDEGVLY<br>YSMTINDEQNDIKDEDKGESIITIGEFATVRATRHYVNQDAP<br>FGVIHLDITTENGTKTYSYNRKEGEFAINWLVPIGEDSPASIK<br>ISVDELDQQRNIIEVPKLYSIDLDNQTLEQWKTQGNVSFSVT<br>RPEHNIAISWPSVSYKAAQKEGSRHKRWAHWHTGLALCWL<br>VPMDAIYNYITQQNCTLGDNWFGGSYETVAGTPKVITVKQ<br>GIEQKPVEQRIHFSKGNAMSALAAHRVCGVPLETLARSRKP<br>RDLTDDLSCAYQAQNIVSLFVATRILFSHLDSVFTLNLDEQE<br>PEVAERLSDLRRINENNPGMVTQVLTVARQIYNDYVTHHPG<br>LTPEQTSAGAQA |
| SEQ ID NO: 13 | IL-10 delivery construct (cholix V1L) | MLEEALNIFDECRSPCSLTPEPGKPIQSKLSIPSDVVLDEGVL<br>YYSMTINDEQNDIKDEDKGESIITIGEFATVRATRHYVNQDA<br>PFGVIHLDITTENGTKTYSYNRKEGEFAINWLVPIGEDSPASI<br>KISVDELDQQRNIIEVPKLYSIDLDNQTLEQWKTQGNVSFSV<br>TRPEHNIAISWPSVSYKAAQKEGSRHKRWAHWHTGLALCW<br>LVPMDAIYNYITQQNCTLGDNWFGGSYETVAGTPKVITVKQ<br>GIEQKPVEQRIHFSKGNAMSALAAHRVCGVPLETLARSRKP<br>RDLTDDLSCAYQAQNIVSLFVATRILFSHLDSVFTLNLDEQE<br>PEVAERLSDLRRINENNPGMVTQVLTVARQIYNDYVTHHPG<br>LTPEQTSAGAQAGGGGSGGGGSGGGGSPGQGTQSENSCTH<br>FPGNLPNMLRDLRDAFSRVKTFFQMKDQLDNLLLKESLLED<br>FKGYLGCQALSEMIQFYLEEVMPQAENQDPDIKAHVNSLGE<br>NLKTLRLRLRRCHRFLPCENKSKAVEQVKNAFNKLQEKGIY<br>KAMSEFDIFINYIEAYMTMKIRN |
| SEQ ID NO: 151 | Humira Fab light chain | DIQMTQSPSSLSASVGDRVTITCRASQGIRNYLAWYQQKPG<br>KAPKLLIYAASTLQSGVPSRFSGSGSGTDFTLTISSLQPEDVA<br>TYYCQRYNRAPYTFGQGTKVEIKRTVAAPSVFIFPPSDEQLK |

TABLE 1-continued

| Sequences | | |
|---|---|---|
| SEQ ID NO: | Description | Sequence |
| | | SGTASVVCLLNNFYPREAKVQWKVDNALQSGNSQESVTEQ DSKDSTYSLSSTLTLSKADYEKHKVYACEVTHQGLSSPVTK SFNRGEC |
| SEQ ID NO: 152 | Humira Fab heavy chain | EVQLVESGGGLVQPGRSLRLSCAASGFTFDDYAMHWVRQA PGKGLEWVSAITWNSGHIDYADSVEGRFTISRDNAKNSLYL QMNSLRAEDTAVYYCAKVSYLSTASSLDYWGQGTLVTVSS ASTKGPSVFPLAPSSKSTSGGTAALGCLVKDYFPEPVTVSW NSGALTSGVHTFPAVLQSSGLYSLSSVVTVPSSSLGTQTYIC NVNHKPSNTKVDKKVEPKSC |
| SEQ ID NO: 153 | Remicade Fab light chain | DILLTQSPAILSVSPGERVSFSCRASQFVGSSIHWYQQRTNGS PRLLIKYASESMSGIPSRFSGSGSGTDFTLSINTVESEDIADYY CQQSHSWPFTFGSGTNLEVKRTVAAPSVFIFPPSDEQLKSGT ASVVCLLNNFYPREAKVQWKVDNALQSGNSQESVTEQDSK DSTYSLSSTLTLSKADYEKHKVYACEVTHQGLSSPVTKSFN RGEC |
| SEQ ID NO: 154 | Remicade Fab heavy chain | EVKLEESGGGLVQPGGSMKLSCVASGFIFSNHWMNWVRQS PEKGLEWVAEIRSKSINSATHYAESVKGRFTISRDDSKSAVY LQMTDLRTEDTGVYYCSRNYYGSTYDYWGQGTTLTVSSAS TKGPSVFPLAPSSKSTSGGTAALGCLVKDYFPEPVTVSWNS GALTSGVHTFPAVLQSSGLYSLSSVVTVPSSSLGTQTYICNV NHKPSNTKVDKKVEPKSCDKT |

TABLE 2

| Additional cholix polypeptides | |
|---|---|
| SEQ ID NO: 130 | VEDELNIFDECRSPCSLTPEPGKPIQSKLSIPSDVVLDEGVLYYSMTINDEQN DIKDEDKGESIITIGEFATVRATRHYVNQDAPFGVIHLDITTENGTKTYSYNR KEGEFAINWLVPIGEDSPASIKISVDELDQQRNIIEVPKLYSIDLDNQTLEQW KTQGNVSFSVTRPEHNIAISWPSVSYKAAQKEGSRHKRWAHWHTGLALC WLVPMDAIYNYITQQNCTLGDNWFGGSYETVAGTPKVITVKQGIEQKPVE QRIHFSKGNAMSALAAHRVCGVPLETLARSRKPRDLTDDLSCAYQAQNIVS LFVATRILFSHLDSVFTLNLDEQEPEVAERLSDLRRINENNPGMVTQVLTVA RQIYNDYVTHHPGLTPEQTSAGAQAADILSLFCPDADKSCVASNNDQANIN IESRSGRSYLPENRAVITPQGVTNWTYQELEATHQALTREGYVFVGYHGTN HVAAQTIVNRIAPVPRGNNTENEEKWGGLYVATHAEVAHGYARIKEGTGE YGLPTRAERDARGVMLRVYIPRASLERFYRTNTPLENAEEHITQVIGHSLPL RNEAFTGPESAGGEDETVIGWDMAIHAVAIPSTIPGNAYEELAIDEEAVAKE QSISTKPPYKERKDELK |
| SEQ ID NO: 131 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW ENQGNVSFAVTRPEQSIAKQSIAKQSIAISWPSVSYKAAQKEGSRHKRWAH WHTGLALCWLVPIDAIYNYITQQNCTLGDNWFGGSYETVAGTPKAITVKQ GIEQKPVEQRIHFSKKNAMEALAAHRVCGVPLETLARSRKPRDLPDDLSCA YQAQNIVSLFVATRILFSHLDSVFTLNLDEQEPEVAERLSALRQINENNPGM VTQVLTVARQIYNDYVTHHPGLTPEQTSAGAQAADILSLFCPDADKPCVAS NNDQANINVESRSGRSYLPENRAVITPQGVTNWTYQELEATHQALTREGY VFVGYHGTNHVAAQTIVNRIAPVPRGNNTENEEKWGGLYVATHAEVAHG YARIKEGTGEYGLPTRAEREARGVMLRVYIPRASLERFYRTNTPLENAERHI TQVIGHSLPLRNEAFTGPESAGGEDETVIGWDMAIHAVAIPSTIPGNAYEEL AIDEEAVAKEQSISAKPPYKEQKDELK |
| SEQ ID NO: 132 | VEDELNIFDECRSPCSLTPEPGKPIQSKLSIPSDVVLDEGVLYYSMTINDEQN DIMDEGKGESIITIGEFATVRATRHYVNQDAPFGVINLDITTENGTKTYSYN RKEGEFAINWLVPIGEDSPASIKISVDELDQQRNIIEVPKLYSIDLDNQTLEQ WENQGNVSFAVTRPEQSIAKQSIAISWPSVSYKAAQKEGSRHKRWAHWHT GLALCWLVPIDAIYNYITQQNCTLGDNWFGGSYETVAGTPKAITVKQGIEQ KPVEQRIHFSKKNAMEALAAHRVCGVPLETLARSRKPRDLTDDLSCAYQA QNIVSLFVATRILFSHLDSVFTLNLDEQEPEVAERLSALRQINENNPGMVTQ VLTVARQIYNDYVTHHPGLTPEQTSAGAQAADILSLFCPDADKSCVASNND QANINIESRSGRSYLPENRAVITPQGVTNWTYQELEATHQALTREGYVFVG YHGTNHVAAQTIVNRIAPVPRGNNTENEEKWGGLYVATHAEVAHGYARIK EGTGEYGLPTRAERDARGVMLRVYIPRASLERFYRTNTPLENAEEHITQVIG HSLPLRNEAFTGPESAGGEDETVIGWDMAIHAVAIPSTIPGNAYEELAIDEE AVAKEQSISTKPPYKERKDELK |
| SEQ ID NO: 133 | VEDELNIFDECRSPCSLTPEPGKPIQSKLSIPSDVVLDEGVLYYSMTINDEQN DIKDEDKGESIITIGEFATVRATRHYVNQDAPFGVIHLDITTENGTKTYSYNR |

TABLE 2-continued

| Additional cholix polypeptides | |
|---|---|
| | KEGEFAINWLVPIGEDSPASIKISVDELDQQRNIIEVPKLYSIDLDNQTLEQW<br>ENQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLTDDLSCAYQAQNIVSL<br>FVATRILFSHLDSVFTLNLDEQEPEVAERLSALRQINENNPGMVTQVLTVAR<br>QIYNDYVTHHPGLTPEQTSAGAQAADILSLFCPDADKPCVASNNDQANINIE<br>SRSGRSYLPENRAVITPQGVTNWTYQELEATHQALTREGYVFVGYHGTNH<br>VAAQTIVNRIAPVPRGNNTENEEKWGGLYVATHAEVAHGYARIKEGTGEY<br>GLPTRAERDARGVMLRVYIPRASLERFYRTNTPLENAEEHITQVIGHSLPLR<br>NEAFTGPESAGGEDETVIGWDMAIHAVAIPSTIPGNAYERLTPAEEAVVKE<br>AIAKEQSISAKPPYKEQKDELK |
| SEQ ID NO: 134 | VEDELNIFDECRSPCSLTPEPGKPIQSKLSIPSDVVLDEGVLYYSMTINDEQN<br>DIKDEDKGESIITIGEFATVRATRHYVNQDAPFGVIHLDITTENGTKTYSYNR<br>KEGEFAINWLVPIGEDSPASIKISVDELDQQRNIIEVPKLYSIDLDNQTLEQW<br>ENQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLPDDLSCAYQAQNIVSL<br>FVATRILFSHLDSVFTLNLDEQEPEVAERLSALRQINENNPGMVTQVLTVAR<br>QIYNDYVTHHPGLTPEQTSAGAQAADILSLFCPDADKPCVASNNDQANINIE<br>SRSGRSYLPENRAVITPQGVTNWTYQELEATHQALTREGYVFVGYHGTNH<br>VAAQTIVNRIAPVPRGNNTENEEKWGGLYVATHAEVAHGYARIKEGTGEY<br>GLPTRAERDARGVMLRVYIPRASLERFYRTNTPLENAEEHITQVIGHSLPLR<br>NEAFTGPESAGGEDETVIGWDMAIHAVAIPSTIPGNAYERLTPAEEAVVKE<br>AIAKEQSISAKPPYKEQKDELK |
| SEQ ID NO: 135 | VEDELNIFDECRSPCSLTPEPGKQIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>KTQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLTDDLSCVYQAQNIVSL<br>FVATRILFSHLDSVFTLNLDEQEPEVAERLSALRQINENNPGMVTQVLTVAR<br>QIYNDYVTHHPGLTPEQTSAGAQAADILSLFCPDADKSCVASNNDQANINIE<br>SRSGRSYLPENRAVITPQGVTNWTYQELEATHQALTREGYVFVGYHGTNH<br>VAAQTIVNRIAPVPRGNNTENEKKWGGLYVATHAEVAHGYARIKEGTGEY<br>GLPTRAERDARGVMLRVYIPRASLERFYRTNTPLENAEEHITQVIGHSLPLR<br>NEAFTGPESAGGEDETVIGWDMAIHAVAIPSTIPGNAYEELAIDEEAVAKEQ<br>SISTKPPYKERKDELK |
| SEQ ID NO: 136 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>KTQGNVSFSVTRPEHNIAISWPSVSYKAAQKEGSRHKRWAHWHTGLALC<br>WLVPMDAIYNYITQQNCTLGDNWFGGSYETVAGTPKVITVKQGIEQKPVE<br>QRIHFSKGNAMSALAAHRVCGVPLETLARSRKPRDLTDDLSCAYQAQNIVS<br>LFVATRILFSHLDSVFTLNLDEQEPEVAERLSDLRRINENNPGMVTQVLTVA<br>RQIYNDYVTHHPGLTPEQTSAGAQAADILSLFCPDADKSCVASNNDQANIN<br>IESRSGRSYLPENRAVITPQGVTNWTYQELEATHQALTREGYVFVGYHGTN<br>HVAAQTIVNRIAPVPRGNNTENEEKWGGLYVATHAEVAHGYARIKEGTGE<br>YGLPTRAERDARGVMLRVYIPRASLERFYRTNTPLENAEEHITQVIGHSLPL<br>RNEAFTGPESAGGEDETVIGWDMAIHAVAIPSTIPGNAYEELAIDEEAVAKE<br>QSISAKPPYKERKDELK |
| SEQ ID NO: 137 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>KTQGNVSFSVTRPEHNIAISWPSVSYKAAQKEGSRHKRWAHWHTGLALC<br>WLVPMDAIYNYITQQNCTLGDNWFGGSYETVAGTPKVITVKQGIEQKPVE<br>QRIHFSKGNAMSALAAHRVCGVPLETLARSRKPRDLTDDLSCAYQAQNIVS<br>LFVATRILFSHLDSVFTLNLDEQEPEVAERLSDLRRINENNPGMVTQVLTVA<br>RQIYNDYVTHHPGLTPEQTSAGAQAADILSLFCPDADKSCVASNNDQANIN<br>IESRSGRSYLPENRAVITPQGVTNWTYQELEATHQALTREGYVFVGYHGTN<br>HVAAQTIVNRIAPVPRGNNTENEEKWGGLYVSTHAEVAHGYARIKEGTGE<br>YGLPTRAERDARGVMLRVYIPRASLERFYRTNTPLENAEEHITQVIGHSLPL<br>RNEAFTGPESAGGEDETVIGWDMAIHAVAIPSTIPGNAYEELAIDEEAVAKE<br>QSISTKPPYKERKDELK |
| SEQ ID NO: 138 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>KTQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLTDDLSCVYQAQNIVSL<br>FVATRILFSHLDSVFTLNLDEQEPEVAERLSALRQINENNPGMVTQVLTVAR<br>QIYNDYVTHHPGLTPEQTSAGAQAADILSLFCPDADKSCVASNNDQANINIE<br>SRSGRSYLPENRAVITPQGVTNWTYQELEATHQALTREGYVFVGYHGTNH<br>VAAQTIVNRIAPVPRGNNTENEKKWGGLYVATHAEVAHGYARIKEGTGEY |

TABLE 2-continued

| Additional cholix polypeptides | |
|---|---|
| | GLPTRAERDARGVMLRVYIPRASLERFYRTNTPLENAEEHITQVIGHSLPLR NEAFTGPESAGGEDETVIGWDMAIHAVAIPSTIPGNAYEELAIDEEAVAKEQ SISTKPPYKERKDELK |
| SEQ ID NO: 139 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW KTQGNVSFSVTRPEHNIAISWPSVSYKAAQKEGSRHKRWAHWHTGLALC WLVPIDAIYNYITQQNCTLGDNWFGGSYETVAGTPKAITVKQGIEQKPVEQ RIHFSKKNAMEALAAHRVCGVPLETLARSRKPRDLPDDLSCAYQAQNIVSL FVATRILFSHLDSVFTLNLDEQEPEVAERLSALRQINENNPGMVTQVLTVAR QIYNDYVTHHPGLTPEQTSAGAQAADILSLFCPDADKPCVASNNDQANINIE SRSGRSYLPENRAVITPQGVTNWTYQELEATHQALTREGYVFVGYHGTNH VAAQTIVNRIAPVPRGNNTENEEKWGGLYVATHAEVAHGYARIKEGTGEY GLPTRAERDARGVMLRVYIHRASLERFYRTNTPLENAEEHITQVIGHSLPLR NEAFTGPESAGGEDETVIGWDMAIHAVAIPSTIPGNAYEELAIDEEAVAKEQ SISTKPPYKERKDELK |
| SEQ ID NO: 140 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW KTQGNVSFSVTRPEHNIAISWPSVSYKAAQKEGSRHKRWAHWHTGLALC WLVPIDAIYNYITQQNCTLGDNWFGGSYETVAGTPKAITVKQGIEQKPVEQ RIHFSKKNAMEALAAHRVCGVPLETLARSRKPRDLPDDLSCAYQAQNIVSL FVATRILFSHLDSVFTLNLDEQEPAVAERLSALRQINENNPGMVTQVLTVA RQIYNDYVTHHPGLTPEQTSAGAQAADILSLFCPDADKSCVASDNDQANIN IESRSGRSYLPENRAVITPQGVTNWTYQELEATHQALTREGYVFVGYHGTN HVAAQTIVNRIAPVPRGNNTENEEKWGGLYVATHAEVAHGYARIKEGTGE YGLPTRAERDARGVMLRVYIPRASLERFYRTNTPLENAEEHITQVIGHSLPL RNEAFTGPESAGGEDETVIGWDMAIHAVAIPSTIPGNAYEELAIDEEAVAKE QSISTKPPYKERKDELK |
| SEQ ID NO: 141 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW KTQGNVSFSVTRPEHNIAISWPSVSYKAAQKEGSRHKRWAHWHTGLALC WLVPIDAIYNYITQQNCTLGDNWFGGSYETVAGTPKAITVKQGIEQKPVEQ RIHFSKKNAMEALAAHRVCGVPLETLARSRKPRDLPDDLSCAYQAQNIVSL FVATRILFSHLDSVFTLNLDEQEPEVAERLSALRQINENNPGMVTQVLTVAR QIYNDYVTHHPGLIPEQTSAGAQAADILSLFCPDADKPCVASNNDQANINIE SRSGRSYLPENRAVITPQGVTNWTYQELEATHQALTREGYVFVGYHGTNH VAAQTIVNRIAPVPRGNNTENEEKWGGLYVATHAEVAHGYARIKEGTGEY GLPTRAEREARGVMLRVYIPRASLERFYRTNTPLENAERHITQVIGHSLPLR NEAFTGPESAGGEDETVIGWDMAIHAVAIPSTIPGNAYEELAIDEEAVAKEQ SISAKPPYKERKDELK |
| SEQ ID NO: 142 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW KTQGNVSFSVTRPEHNIAISWPSVSYKAAQKEGSRHKRWAHWHTGLALC WLVPIDAIYNYITQQNCTLGDNWFGGSYETVAGTPKAITVKQGIEQKPVEQ RIHFSKKNAMEALAAHRVCGVPLETLARSRKPRDLPDDLSCAYQAQNIVSL FVATRILFSHLDSVFTLNLDEQEPEVAERLSALRQINENNPGMVTQVLTVAR QIYNDYVTHHPGLIPEQTSAGAQAADILSLFCPDADKPCVASNNDQANINIE SRSGRSYLPENRAVITPQGVTNWTYQELEATHQALTREGYVFVGYHGTNH VAAQTIVNRIAPVPRGNNTENEEKWGGLYVATHAEVAHGYARIKEGTGEY GLPTRAEREARGVMLRVYIPRASLERFYRTNTPLENAERHITQVIGHSLPLR NEAFTGPESAGGEDETVIGWDMAIHAVAIPSTIPGNAYEELAIDEEAVAKEQ SISAKPPYKEQKDELK |
| SEQ ID NO: 143 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW KTQGNVSFSVTRPEHNIAISWPSVSYKAAQKEGSRHKRWAHWHTGLALC WLVPIDAIYNYITQQNCTLGDNWFGGSYETVAGTPKAITVKQGIEQKPVEQ RIHFSKKNAMEALAAHRVCGVPLETLARSRKPRDLPDDLSCAYQAQNIVSL FVATRMLFSHLDSVFTLNLDEQEPEVAERLSALRQINENNPGMVTQVLTVA RQIYNDYVTHHPGLIPEQTSAGAQAADILSLFCPDADKPCVASNNDQANINI ESRSGRSYLPENRAVITPQGVTNWTYQELEATHQALTREGYVFVGYHGTN HVAAQTIVNRIAPVPRGNNTENEEKWGGLYVATHAEVAHGYARIKEGTGE YGLPTRAEREARGVMLRVYIPRASLERFYRTNTPLENAERHITQVIGHSLPL RNEAFTGPESAGGEDETVIGWDMAIHAVAIPSTIPGNAYEELAIDEEAVAKE QSISAKPPYKEQKDELK |
| SEQ ID NO: 144 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW KTQGNVSFSVTRPEHNIAISWPSVSYKAAQKEGSRHKRWAHWHTGLALC |

TABLE 2-continued

| Additional cholix polypeptides | |
|---|---|
| | WLVPIDAIYNYITQQNCTLGDNWFGGSYETVAGTPKAITVKQGIEQKPVEQ<br>RIHFSKKNAMEALAAHRVCGVPLETLARSRKPRDLPDDLSCAYQAQNIVSL<br>FVATRILFSHLDSVFTLNLDEQEPEVAERLSALRQINENNPGMVTQVLTVAR<br>QIYNDYVTHHPGLTPEQTSAGAQAADILSLFCPDADKSCVASNNDQANINIE<br>SRSGRSYLPENRAVITPQGVTNWTYQELEATHQALTREGYVFVGYHGTNH<br>VAAQTIVNRIAPVPRGNNTENEEKWGGLYVATHAEVAHGYARLKKGTGN<br>AELPTRAERDARGVMLRVYIPRASLERFYRTNTPLENAEEHITHVIGHSLPL<br>RNEAFTGPERVDGEDETVIGWDMAIHAVAIPSTIPGNAYEVLAIDEEAVAEE<br>QSISAKPPYKERKDELK |
| SEQ ID NO: 145 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>KTQGNVFFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLPDDLSCAYQAQNIVSL<br>FVATRILFSHLDSVFTLNLDEQEPEVTERLSALRQINENNPGMVTQVLTVAR<br>QIYNDYVTHHPGLTPEQTSAGAQAADILSLFCPDADKPCVASNNDQANINIE<br>SRSGRSYLPENRAVITPQGVTNWTYQELEATHQALTREGYVFVGYHGTNH<br>VAAQTIVNRIAPVPRGNNTENEEKWGGLYVATHAEVAHGYARIKEGTGEY<br>GLPTRAERDARGVMLRVYIHRASLERFYRTNTPLENAEEHITQVIGHSLPLR<br>NEAFTGPESAGGEDETVIGWDMAIHAVAIPSTIPGNAYEELAIDEEAVAKEQ<br>SISTKPPYKERKDELK |
| SEQ ID NO: 146 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>ENQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLPDDLSCAYQAQNIVSL<br>FVATRILFSHLDSVFTLNLDEQEPAVAERLSALRQINENNPGMVTQVLTVA<br>RQIYNDYVTHHPGLTPEQTSAGAQAADILSLFCPDADKSCVASNNDQANIN<br>IESRSGRSYLPENRAVITPQGVTNWTYQELEATHQALTREGYVFVGYHGTN<br>HVAAQTIVNRIAPVPRGNNTENEEKWGGLYVATHAEVAHGYARIKEGTGE<br>YGLPTRAERDARGVMLRVYIPRASLERFYRTNTPLENAEEHITQVIGHSLPL<br>RNEAFTGPESAGGEDETVIGWDMAIHAVAIPSTIPGNAYEELAIDEEAVAKE<br>QSISAKPPYKERKDELK |
| SEQ ID NO: 20 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>ENQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLPDDLSCAYQAQNIVSL<br>FVATRILFSHLDSVFTLNLDEQEPAVAERLSALRQINENNPGMVTQVLTVA<br>RQIYNDYVTHHPGLTPEQTSAGAQAADILSLFCPDADKSCVALNNDQANIN<br>IESRSGRSYLPENRAVITPQGVTNWTYQELEATHQALTREGYVFVGYHGTN<br>HVAAQTIVNRIAPVPRGNNTENEEKWGGLYVATHAEVAHGYARIKEGTGE<br>YGLPTRAERDARGVMLRVYIPRASLERFYRTNTPLENAEEHITQVIGHSLPL<br>RNEAFTGPESAGGEDETVIGWDMAIHAVAIPSTIPGNAYEELAIDEEAVAKE<br>QSISAKPPYKERKDELK |
| SEQ ID NO: 21 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>ENQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLTDDLSCAYQAQNIVSL<br>FVATRILFSHLDSVFTLNLDEQAPEVAERLSALRQINENNPGVVTQVLTVAR<br>QIYNDYVTHHPGLTPEQTSAGAQAADILSLFCPDADKSCVASNNDQANINIE<br>SRSGRSYLPENRAVITPQGVTNWTYQELEATHQALTREGYVFVGYHGTNH<br>VAAQTIVNRIAPVPRGNNTENEEKWGGLYVATHAEVAHGYARIKEGTGNG<br>GLPTRAERETRGVMLRVYIPRASLERFYRTNTPLENAEEHITQVIGHSLPLR<br>NEAFTGPESAGGEDETVIGWDMAIHAVAIPSTIPGNAYEELAIDEEAVAKEQ<br>SISAKPPYKEQKDELK |
| SEQ ID NO: 22 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>ENQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKTVEQ<br>RIHFSKKNAMEALAAHRVCGVPLETLARSRKPRDLTDDLSCVYQAQNIVSL<br>FVATRILFSHLDSVFTLNLEEQEPEVAERLSALRQINENNPGMVTQVLTVAR<br>QIYNDYVTHHPGLTPEQTSAGAQAADILSLFCPDADKSCVASNNDQANINIE<br>SRSGRSYLPENRAVITPQGVTNWTYQELEATHQALTREGYVFVGYHGTNH<br>VAAQTIVNRIAPVPRGNNTENEEKWGGLYVATHAEVAHGYARIKEGTGNG |

TABLE 2-continued

| Additional cholix polypeptides | |
|---|---|
| | GLPTRAERETRGVMLRVYIPRASLERFYRTNTPLENAEEHITDVIGHSLPLR<br>NEAFTGPESAGGEDETVIGWDMAIHAVAIPSTIPGNAYEELAIDEEAVAKEQ<br>SISAKPPYKEQKDELK |
| SEQ ID NO: 23 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>ENQGNVSFSVTRPEHNIAISWPSVSYKAAQKEGSRHKRWAHWHTGLALC<br>WLVPIDAIYNYITQQNCTLGDNWFGGSYETVAGTPKAIMVKQGIEQKPVEQ<br>RIHFSKKNAMEALAAHRVCGVPLETLARSRKPRYLPDDLSCAYQAQNIVSL<br>FVATRILFSHLDSVFTLNLDEQEPEVAERLSALRQINENNPGMVTQVLTVAR<br>QIYNDYVTHHPGLTPEQTSAGAQAADILSLFCPDADKSCVASNNDQANINIE<br>SRSGRSYLPENRAVITPQGVTNWTYQELEATHQALTREGYVFVGYHGTNH<br>VAAQTIVNRIAPVPRGNNTENEEKWGGLYVATHAEVAHGYARIKEGTGEY<br>GLPTRAERDARGVMLRVYIPRASLERFYRTNTPLENAEEHITQVIGHSLPLR<br>NEAFTGPERVDGEDETVIGWDMAIHAVAIPSTIPGNAYEELAIDEEAVAKEQ<br>SISPKPPYKERKDELK |
| SEQ ID NO: 24 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KDGEFAINWLVPIGEDSPASIKISVDELDQQRNIIEVPKLYSIDLDNQTLEQW<br>KTQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLPDDLSCAYQAQNIVSL<br>FVATRILFSHLDSVFTLNLDEQEPAVAERLSAIRQINENNPGMVTQVLTVAR<br>QIYNDYVTHHPGLTPEQTSAGAQAADILSLFCPDADKSCVASDNDQANINIE<br>SRSGRSYLPENRAVITPQGVTNWTYQELEATHQALTREGYVFVGYHGTNH<br>VAAQTIVNRIAPVPRGNNTENEEKWGGLYVATHAEVAHGYARIKEGTGEY<br>GLPTRAERDARGVMLRVYIPRASLERFYRTNTPLENAEEHITQVIGHSLPLR<br>NEAFTGPESAGGEDETVIGWDMAIHAVAIPSTIPGNAYEELAIDEEAVAKEQ<br>SISTKPPYKERKDELK |
| SEQ ID NO: 25 | VEDELNIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KDGEFAINWLVPIGEDSPASIKISVDELDQQRNIIEVPKLYSIDLDNQTLEQW<br>KTQGNVSFSVTRPEHNIAISWPSVSYKAAQKEGSRHKRWAHWHTGLALC<br>WLVPIDAIYNYITQQNCTLGDNWFGGSYETVAGTPKAITVKQGIEQKPVEQ<br>RIHFSKKNAMEALAAHRVCGVPLETLARSRKPRDLPDDLSCAYQAQNIVSL<br>FVATRILFSHLDSVFTLNLDEQEPEVAERLSALRQINENNPGMVTQVLTVAR<br>QIYNDYVTHHPGLTPEQTSAGAQAADILSLFCPDADKHCVASNNDQANINV<br>ESRSGRSYLPENRAVITPQGVTNWTYQELEATHQALTREGYVFVGYHGTN<br>HVAAQTIVNRIAPVPRGNNTENEEKWGGLYVATHAEVAHGYARIKEGTGE<br>YGLPTRAERDARGVMLRVYIPRASLERFYRTNTPLENAERHITQVIGHSLPL<br>RNEAFTGPESAGGEDETVIGWDMAIHAVAIPSTIPGNAYEELAIDEEAVAKE<br>QSISAKPPYKERKDELK |
| SEQ ID NO: 26 | VEDELNIFDECRSPCSLTPEPGKPIQSKLSIPSDVVLDEGVLYYSMTINDEQN<br>DIKDEDKGESIITIGEFATVRATRHYVNQDAPFGVIHLDITTENGTKTYSYNR<br>KEGEFAINWLVPIGEDSPASIKISVDELDQQRNIIEVPKLYSIDLDNQTLEQW<br>KTQGNVSFSVTRPEHNIAISWPSVSYKAAQKEGSRHKRWAHWRTGLALCW<br>LVPMDAIYNYITQQNCTLGDNWFGGSYETVAGTPKVITVKQGIEQKPVEQR<br>IHFSKGNAMSALAAHRVCGVPLETLARSRKPRDLTDDLSCAYQAQNIVSLF<br>VATRILFSHLDSVFTLNLEEQEPEVAERLSALRQINENNPGMVTQVLTVARQ<br>IYNDYVTHHPGLTPEQTSAGAQAADILSLFCPDADKSCVASNNDQANINIES<br>RSGRSYLPENRAVITPQGVTNWTYQELEATHQALTREGYVFVGYHGTNHV<br>AAQTIVNRIAPVPRGNNTENEEKWGGLYVATHAEVAHGYARIKEGTGEYG<br>LPTRAERDARGVMLRVYIPRASLERFYRTNTPLENAEEHITQVIGHSLPLRN<br>EAFTGPESAGGEDETVIGWDMAIHAVAIPSTIPGNAYEELAIDEEAVAKEQS<br>ISTKPPYKERKDELK |
| SEQ ID NO: 27 | VEDELNIFDECRSPCSLTPEPGKPIQSKLSIPSDVVLDEGVLYYSMTINDEQN<br>DIKDEDKGESIITIGEFATVRATRHYVNQDAPFGVIHLDITTENGTKTYSYNR<br>KEGEFAINWLVPIGEDSPASIKISVDELDQQRNIIEVPKLYSIDLDNQTLEQW<br>KTQGNVSFSVTRPEHNIAISWPSVSYKAAQKEGSRHKRWAHWHTGLALC<br>WLVPMDAIYNYITQQNCTLGDNWFGGSYETVAGTPKVITVKQGIEQKPVE<br>QRIHFSNGNAMSALAAHRVCGVPLETLARSRKPRDLTDDLSCAYQAQNIVS<br>LFVATRILFSHLDSVFTLNLDEQEPEVAERLSDLRRINENNPGMVTQVLTVA<br>RQIYNDYVTHHPGLTPEQTSAGAQAADILSLFCPDADKSCVASNNDQANIN<br>IESRSGRSYLPENRAVITPQGVTNWTYQELEATHQALTREGYVFVGYHGTN<br>HVAAQTIVNRIAPVPRGNNTENEEKWGGLYVATHAEVAHGYARIKEGTGE<br>YGLPTRAERDARGVMLRVYIPRASLERFYRTNTPLENAEEHITQVIGHSLPL<br>RNEAFTGPESAGGEDETVIGWDMAIHAVAIPSTIPGNAYEELAIDEEAVAKE<br>QSISTKPPYKERKDELK |
| SEQ ID NO: 28 | VEDELNIFDECRSPCSLTPEPGKPIQSKLSIPSDVVLDEGVLYYSMTINDEQN<br>DIKDEDKGESIITIGEFATVRATRHYVNQDAPFGVIHLDITTENGTKTYSYNR<br>KEGEFAINWLVPIGEDSPASIKISVDELDQQRNIIEVPKLYSIDLDNQTLEQW<br>KTQGNVSFSVTRPEHNIAISWPSVSYKAAQKEGSRHKRWAHWHTGLALC |

TABLE 2-continued

| Additional cholix polypeptides | |
|---|---|
| | WLVPMDAIYNYITQQNCTLGDNWFGGSYETVAGTPKVITVKQGIEQKPVE |
| | QRIHFSKGNAMSALAAHRVCGVPLETLARSRKPRDLTDDLSCAYQAQNIVS |
| | LFVATRILFSHLDSVFTLNLDEQEPEVAERLSDLRRINENNPGMVTQVLTVA |
| | RQIYNDYVTHHPGLTPEQTSAGAQAADILSLFCPDADKSCVASNNDQANIN |
| | IESRSGRSYLLENRAVITPQGVINWTYQELEATHQALTREGYVFVGYHGTN |
| | HVAAQTIVNRIAPVPRGNNTENEEKWGGLYVATHAEVAHGYARIKEGTGE |
| | YGLPTRAERDARGVMLRVYIPRASLERFYRTNTPLENAEEHITQVIGHSLPL |
| | RNEAFTGPESAGGEDETVIGWDMAIHAVAIPSTIPGNAYEELAIDEEAVAKE |
| | QSISTKPPYKERKDELK |
| SEQ ID NO: 29 | VEDELNIFDECRSPCSLTPEPGKPIQSKLSIPSDVVLDEGVLYYSMTINDEQN |
| | DIKDEDKGESIITIGEFATVRATRHYVNQDAPFGVIHLDITTENGTKTYSYNR |
| | KEGEFAINWLVPIGEDSPASIKISVDELDQQRNIIEVPKLYSIDLDNQTLEQW |
| | KTQGNVSFSVTRPEHNIAISWPSVSYKAAQKEGSRHKRWAHWHTGLALC |
| | WLVPMDAIYNYITQKNCTLGDNWFGGSYETVAGTPKVITVKQGIEQKPVE |
| | QRIHFSKGNAMSALAAHRVCGVPLETLARSRKPRDLPDDLSCAYQAQNIVS |
| | LFVATRILFSHLDSVFTLNLDEQEPEVAERLSDLRRINENNPGMVTQVLTVA |
| | RQIYNDYVTHHPGLTPEQTSAGAQAADILSLFCPDADKSCVASNNDQANIN |
| | IESRSGRSYLPENRAVITPQGVTNWTYQELEATHQALTREGYVFVGYHGTN |
| | HVAAQTIVNRIAPVPRGNNTENEEKWGGLYVATHAEVAHGYARIKEGTGE |
| | YGLPTRAERDARGVMLRVYIPRASLERFYRTNTPLENAEEHITQVIGHSLPL |
| | RNEAFTGPESAGGEDETVIGWDMAIHAVAIPSTIPGNAYEELAIDEEAVAKE |
| | QSISAKPPYKEQKDELK |
| SEQ ID NO: 30 | VEDELNIFDECRSPCSLTPEPGKPIQSKLSIPSDVVLDEGVLYYSMTINDEQN |
| | DIKDEDKGESIITIGEFATVRATRHYVNQDAPFGVIHLDITTENGTKTYSYNR |
| | KEGEFAINWLVPIGEDSPASIKISVDELDQQRNIIEVPKLYSIDLDNQTLEQW |
| | KTQGNVSFSVTRPEHNIAISWPSVSYKAAQKEGSRHKRWAHWHTGLALC |
| | WLVPIDAIYNYITQQNCTLGDNWFGGSYETVAGTPKAITVKQGIEQKPVEQ |
| | RIHFSKKNAMEALAAHRVCGVPLETLARSRKPRDLPDDLSCAYQAQNIVSL |
| | FVATRILFSHLDSVFTLNLDEQEPEVAERLSALRQINENNPGMVTQVLTVAR |
| | QIYNDYVTHHPGLTPEQTSAGAQAADILSLFCPDADKSCVASNNDQANINIE |
| | SRSGRSYLPENRAVITPQGVTNWTYQELEATHQALTREGYVFVGYHGTNH |
| | VAAQTIVNRIAPVPRGNNTENEEKWGGLYVATHAEVAHGYARIKEGTGEY |
| | GLPTRAERDARGVMLRVYIPRASLERFYRTNTPLENAEEHITQVIGHSLPLR |
| | NEAFTGPESAGGEDETVIGWDMAIYAVAIPSTIPGNAYEELAIDEEAVAKEQ |
| | SISAKPPYKEQKDELK |
| SEQ ID NO: 31 | VEDELNIFDECRSPCSLTPEPGKPIQSKLSIPSDVVLDEGVLYYSMTINDEQN |
| | DIKDEDKGESIITIGEFATVRATRHYVNQDAPFGVIHLDITTENGTKTYSYNR |
| | KEGEFAINWLVPIGEDSPASIKISVDELDQQRNIIEVPKLYSIDLDNQTLEQW |
| | KTQGNVSFSVTRPEHNIAISWPSVSYKAAQKEGSRHKRWAHWHTGLALC |
| | WLVPIDAIYNYITQQNCTLGDNWFGGSYETVAGTPKAITVKQGIEQKPVEQ |
| | RIHFSKKNAMEALAAHRVCGVPLETLARSRKPRDLPDDLSCAYQAQNIVSL |
| | FVATRILFSHLDSVFTLNLDEQEPAVAERLSALRQINENNPGMVTQVLTVA |
| | RQIYNDYVTHHPGLTPEQTSAGAQAADILSLFCPDADKPCVASNNDQANIN |
| | VESRSGRSYLPENRAVITPQGVTNWTYQELEATHQALTREGYVFVGYHGT |
| | NHVAAQTIVNRIAPVPRGNNTENEEKWGGLYVATHAEVAHGYARIKEGTG |
| | EYGLPTRAEREARGVMLRVYIPRASLERFYRTNTPLENAERHITQVIGHSLP |
| | LRNEAFTGPESAGGEDETVIGWDMAIHAVAIPSTIPGNAYEELAIDEEAVAK |
| | EQSISAKPPYKEQKDELK |
| SEQ ID NO: 32 | VEDELNIFDECRSPCSLTPEPGKPIQSKLSIPSDVVLDEGVLYYSMTINDEQN |
| | DIKDEDKGESIITIGEFATVRATRHYVNQDAPFGVIHLDITTENGTKTYSYNR |
| | KEGEFAINWLVPIGEDSPASIKISVDELDQQRNIIEVPKLYSIDLDNQTLEQW |
| | ENQGNVSFSVTRPEHNIAISWPSVSYKAAQKEGSRHKRWAHWHTGLALC |
| | WLVPMDAIYNYITQQNCTLGDNWFGGSYETVAGTPKVITVKQGIEQKPVE |
| | QRIHFSKGNAMSALAAHRVCGVPLETLARSRKPRDLTDDLSCAYQAQNIVS |
| | LFVATRILFSHLDSVFTLNLDEQEPEVAERLSDLRRINENNPGMVTQVLTVA |
| | RQIYNDYVTHHPGLTPEQTSAGAQAADILSLFCPDADKSCVASNNDQANIN |
| | IESRSGRSYLPENRAVITPQGVTNWTYQELEATHQALTREGYVFVGYHGTN |
| | HVAAQTIVNRIAPVPRGNNTENEEKWGGLYVATHAEVAHGYARIKEGTGE |
| | YGLPTRAERDARGVMLRVYIPRASLERFYRTNTPLENAEEHITQVIGHSLPL |
| | RNEAFTGPESAGGEDETVIGWDMAIYAVAIPSTIPGNAYEELAIDEEAVAKE |
| | QSISAKPPYKEQKDELK |
| SEQ ID NO: 33 | VEDELNIFDECRSPCSLTPEPGKPIQSKLSIPSDVVLDEGVLYYSMTINDEQN |
| | DIKDEDKGESIITIGEFATVRATRHYVNQDAPFGVIHLDITTENGTKTYSYNR |
| | KEGEFAINWLVPIGEDSPASIKISVDELDQQRNIIEVPKLYSIDLDNQTLEQW |
| | ENQGNVSFSVTRPEHNIAISWPSVSYKAAQKEGSRHKRWAHWHTGLALC |
| | WLVPMDAIYNYITQKNCTLGDNWFGGSYETVAGTPKVITVKQGIEQKPVE |
| | QRIHFSKGNAMSALAAHRVCGVPLETLARSRKPRDLTDDLSCAYQAQNIVS |
| | LFVATRILFSHLDSVFTLNLDEQEPEVAERLSDLRRINENNPGMVTQVLTVA |
| | RQIYNDYVTHHPGLTPEQTSAGAQAADILSLFCPDADKSCVASNNDQANIN |
| | IESRSGRSYLPENRAVITPQGVTNWTYQELEATHQALTREGYVFVGYHGTN |
| | HVAAQTIVNRIAPVPRGNNTENEEKWGGLYVATHAEVAHGYARIKEGTGE |

TABLE 2-continued

| Additional cholix polypeptides | |
|---|---|
| | YGLPTRAERDARGVMLRVYIPRASLERFYRTNTPLENAEEHITQVIGHSLPL RNEAFTGPESAGGEDETVIGWDMAIHAVAIPSTIPGNAYEELAIDEEAVAKE QSISTKPPYKERKDELK |
| SEQ ID NO: 34 | VEDELNIFDECRSPCSLTPEPGKPIQSKLSIPSDVVLDEGVLYYSMTINDEQN DIKDEDKGESIITIGEFATVRATRHYVNQDAPFGVIHLDITTENGTKTYSYNR KEGEFAINWLVPIGEDSPASIKISVDELDQQRNIIEVPKLYSIDLDNQTLEQW ENQGNVSFSVTRPEHNIAISWPSVSYKAAQKEGSRHKRWAHWHTGLALC WLVPIDAIYNYITQQNCTLGDNWFGGSYETVAGTPKAITVKQGIEQKTVEQ RIHFSKKNAMEALAAHRVCGVPLETLARSRKPRDLTDDLSCVYQAQNIVSL FVATRILFSHLDSVFTLNLEEQEPEVAERLSALRQINENNPGMVTQVLTVAR QIYNDYVTHHPGLTPEQTSAGAQAADILSLFCPDADKSCVASNNDQANINIE SRSGRSYLPENRAVITPQGVTNWTYQELEATHQALTREGYVFVGYHGTNH VAAQTIVNRIAPVPRGNNTENEEKWGGLYVATHAEVAHGYARIKEGTGEY GLPTRAERDARGVMLRVYIPRASLERFYRTNTPLENAEEHITQVIGHSLPLR NEAFTGPERVDGEDETVIGWDMAIHAVAIPSTIPGNAYEELAIDEEAVAKEQ SISTKPPYKERKDELK |
| SEQ ID NO: 35 | VEDELNIFDECRSPCSLTPEPGKPIQSKLSIPSDVVLDEGVLYYSMTINDEQN DIKDEDKGESIITIGEFATVRATRHYVNQDAPFGVIHLDITTENGTKTYSYNR KEGEFAINWLVPIGEDSPASIKISVDELDQQRNIIEVPKLYSIDLDNQTLEQW ENQGNVSFSVTRPEHNIAISWPSVSYKAAQKEGSRHKRWAHWHTGLALC WLVPIDAIYNYITQQNCTLGDNWFGGSYETVAGTPKAITVKQGIEQKPVEQ RIHFSKKNAMEALAAHRVCGVPLETLARSRKPRDLPDDLSCAYQAQNIVSL FVATRILFSHLDSVFTLNLDEQEPEVAERLSALRQINENNPGMVTQVLTVAR QIYNDYVTHHPGLTPEQTSAGAQAADILSLFCPDADKPCVASNNDQANINIE SRSGRSYLPENRAVITPQGVTNWTYQELEATHQALTREGYVFVGYHGTNH VAAQTIVNRIAPVPRGNNTENEEKWGGLYVATHAEVAHGYARIKEGTGNG GLPTRAERETRGVMLRVYIPRASLERFYRTNTPLENAEEHITDVIGHSLPLR NEAFTGPESAGGEDETVIGWDMAIHAVAIPSTIPGNAYEELAIDEEAVAKEQ SISAKPPYKEQKDELK |
| SEQ ID NO: 36 | VEDELNIFDECRSPCSLTPEPGKPIQSKLSIPSDVVLDEGVLYYSMTINDEQN DIKDEDKGESIITIGEFATVRATRHYVNQDAPFGVIHLDITTENGTKTYSYNR KEGEFAIHWLVPIGEDSPASIKISVDELDQQRNIIEVPKLYSIDLDNQTLEQW ENQGNVSFSVTRPEHNIAISWPSVSYKAAQKEGSRHKRWAHWHTGLALC WLVPIDAIYNYITQQNCTLGDNWFGGSYETVAGTPKAITVKQGIEQKTVEQ RIHFSKKNAMEALAAHRVCGVPLETLARSRKPRDLTDDLSCVYQAQNIVSL FVATRILFSHLDSVFTLNLEEQEPEVAERLSALRQINENNPGMVTQVLTVAR QIYNDYVTHHPGLTPEQTSAGAQAADILSLFCPDADKSCVASNNDQANINIE SRSGRSYLPENRAVITPQGVTNWTYQELEATHQALTREGYVFVGYHGTNH VAAQTIVNRIAPVPRGNNTENEEKWGGLYVATHAEVAHGYARIKEGTGEY GLPTRAERDARGVMLRVYIPRASLERFYRTNTPLENAEEHITQVIGHSLPLR NEAFTGPESAGGEDETVIGWDMAIHAVAIPSTIPGNAYEELAIDEEAVAKEQ SISTKPPYKERKDELK |
| SEQ ID NO: 37 | VEDELNIFDECRSPCSLTPEPGKPIQSKLSIPSDVVLDEGVLYYSMTINDEQN DIKDEDKGESIITIGEFATIRATRHYVNQDAPFGVINLDITTENGTKTYSYNR KEGEFAINWLVPIGEDSPASIKISVDELDQQRNIIEVPKLYSIDLDNQTLEQW KTQGNVSFSVTRPEHNIAISWPSVSYKAAQKEGSRHKRWAHWHTGLALC WLVPMDAIYNYITQQNCTLGDNWFGGSYETVAGTPKVITVKQGIEQKPVE QRIHFSKGNAMSALAAHRVCGVPLETLARSRKPRDLTDDLSCAYQAQNIVS LFVATRILFSHLDSVFTLNLDEQEPEVAERLSDLRRINENNPGMVTQVLTVA RQIYNDYVTHHPGLTPEQTSAGAQAADILSLFCPDADKSCVASNNDQANIN IESRSGRSYLPENRAVITPQGVTNWTYQELEATHQALTREGYVFVGYHGTN HVAAQTIVNRIAPVPRGNNTENEEKWGGLYVATHAEVAHGYARIKEGTGE YGLPTRAERDARGVMLRVYIPRASLERFYRTNTPLENAERHITQVIGHSLPL RNEAFTGPESAGGEDETVIGWDMAIHAVAIPSTIPGNAYEELAIDEEAVAKE QSISAKPPYKEQKDELK |
| SEQ ID NO: 38 | VEDELNIFDECRSPCSLTPEPGKPIQSKLSIPSDVVLDEGVLYYSMTINDEQN DIKDEDKGESIITFGEFATVRATRHYVNQDAPFGVINLDITTENGTKTYSYN RKEGEFAINWLVPIGEDSPASIKISVDELDQQRNIIEVPKLYSIDLDNQTLEQ WKTQGNVSFSVTRPEHNIAISWPSVSYKAAQKEGSRHKRWAHWHTGLAL CWLVPMDAIYNYITQQNCTLGDNWFGGSYETVAGTPKVITVKQGIEQKPV EQRIHFSKGNAMSALAAHRVCGVPLETLARSRKPRDLTDDLSCAYQAQNIV SLFVATRILFSHLDSVFTLNLDEQEPEVAERLSDLRRINENNPGMVTQVLTV ARQIYNDYVTHHPGLTPEQTSAGAQAADILSLFCPDADKSCVASNNDQANI NIESRSGRSYLPENRAVITPQGVTNWTYQELEATHQALTREGYVFVGYHGT NHVAAQTIVNRIAPVPRGNNTENEEKWGGLYVATHAEVAHGYARIKEGTG EYGLPTRAERDARGVMLRVYIPRASLERFYRTNTPLENAEEHITQVIGHSLP LRNEAFTGPESAGGEDETVIGWDMAIHAVAIPSTIPGNAYEELAIDEEAVAK EQSISTKPPYKERKDELK |
| SEQ ID NO: 39 | VEDELNIFDECRSPCSLTPEPGKPIQSKLSIPGDVVLDEGVLYYSMTINDEQN DIKDEDKGESIITIGEFATVRATRHYVSQDAPFGVINLDITTENGTKTYSFNR KESEFAINWLVPIGEDSPASIKISIDELDQQRNIIEVPKLYSIDLDNQTLEQWK TQGNVSFSVTRPEHNIAISWPSVSYKAAQKEGSRHKRWAHWHTGLALCWL |

TABLE 2-continued

Additional cholix polypeptides

VPIDAIYNYITQQNCTLGDNWFGGSYETVAGTPKAITVKQGIEQKPVEQRIH
FSKKNAMEALAAHRVCGVPLETLARSRKPRDLPDDLSCAYNAQQIVSLFLA
TRILFTHIDSIFTLNLDGQEPEVAERLDDLRRINENNPGMVIQVLTVARQIYN
DYVTHHPGLTPEQTSAGAQAADILSLFCPDADKSCVASNSDQANINIESRSG
RSYLPENRAVITQQGVTNWTYQELEATHQALTQEGYVFVGYHGTNHVAA
QSIVNRISPVPRGSDTESERAWGGLYVSTDASVAYGYARIQEGTADGGGLT
PAERKARGVMLRVYLPQASLERFYRINADLEKERNLVERVIGHPLPLRNEA
FTGTDAEEGSDETAIGWDMAIHGVAIPSTIPGNSYAQLPIDEEAVAKEQSISA
KPPYKEQKDELK

SEQ ID NO: 40    VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
KTQGNVSFSVTRPEHNIAISWPSVSYKAAQKEGSRHKRWAHWHTGLALC
WLVPIDAIYNYITQQNCTLGDNWFGGSYETVAGTPKAITVKQGIEQKPVEQ
RIHFSKKNAMEALAAHRVCGVPLETLARSRKPRDLPDDLSCAYQAQNIVSL
FVATRILFSHLDSVFTLNLDEQEPEVAERLSALRQINENNPGMVTQVLTVAR
QIYNDYVTHHPGLTPEQTSAGAQAADILSLFCPDADKPCVASNNDQANINIE
SRSGRSYLPENRAVITPQGVTNWTYQELEATHQALTREGYVFVGYHGTNH
VAAQTIVNRIAPVPRGNNTENEEKWGGLYVATHAEVAHGYARIKEGTGEY
GLPTRAERDARGVMLRVYIPRASLERFYRTNTPLENAEEHITQVIGHSLPLR
NEAFTGPESAGGEDETVIGWDMAIHAVAIPSTIPGNAYEELAIDEEAVAKEQ
SISTKPPYKERKDELK

SEQ ID NO: 41    VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
KTQGNVSFSVTRPEHNIAISWPSVSYKAAQKEGSRHKRWAHWHTGLALC
WLVPIDAIYNYITQQNCTLGDNWFGGSYETVAGTPKAITVKQGIEQKPVEQ
RIHFSKKNAMEALAAHRVCGVPLETLARSRKPRDLPDDLSCAYQAQNIVSL
FVATRILFSHLDSVFTLNLDEQEPAVAERLSALRQINENNPGMVTQVLTVA
RQIYNDYVTHHPGLTPEQTSAGAQAADILSLFCPDADKSCVASDNDQANIN
IESRSGRSYLPENRAVITPQGVTNWTYQELEATHQALTREGYVFVGYHGTN
HVAAQTIVNRIAPVPRGNNTENEEKWGGLYVATHAEVAHGYARIKEGTGE
YGLPTRAERDARGVMLRVYIPRASLERFYRTNTPLENAEEHITQVIGHSLPL
RNEAFTGPESAGGEDETVIGWDMAIHAVAIPSTIPGNAYEELAIDEEAVAKE
QSISTKPPYKERKDELK

SEQ ID NO: 42    VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
KTQGNVSFSVTRPEHNIAISWPSVSYKAAQKEGSRHKRWAHWHTGLALC
WLVPIDAIYNYITQQNCTLGDNWFGGSYETVAGTPKAITVKQGIEQKPVEQ
RIHFSKKNAMEALAAHRVCGVPLETLARSRKPRDLPDDLSCAYQAQNIVSL
FVATRILFSHLDSVFTLNLDEQEPEVAERLSALRQINENNPGMVTQVLTVAR
QIYNDYVTHHPGLTPEQTSAGAQAADILSLFCPDADKPCVASNNDQANINIE
SRSGRSYLPENRAVITPQGVTNWTYQELEATHQALTREGYVFVGYHGTNH
VAAQNIVNRIAPVPRGNNTENEEKWGGLYVATHAEVAHGYARIKEGTGEY
GLPTRAERDARGVMLRVYIPRASLERFYRTNTPLENAEEHITQVIGHSLPLR
NEAFTGPESAGGEDETVIGWDMAIHAVAIPSTIPGNAYEELAIDEEAVAKEQ
SISTKPPYKERKDELK

SEQ ID NO: 43    VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
KTQGNVSFSVTRPEHNIAISWPSVSYKAAQKEGSRHKRWAHWHTGLALC
WLVPIDAIYNYITQQNCTLGDNWFGGSYETVAGTPKAITVKQGIEQKPVEQ
RIHFSKKNAMEALAAHRVCGVPLETLARSRKPRDLPDDLSCAYQAQNIVSL
FVATRILFSHLDSVFTLNLDEQEPEVAERLSALRQINENNPGMVTQVLTVAR
QIYNDYVTHHPGLTPEQTSAGAQAADILSLFCPDADKPCVASNNDQANINIE
SRSGRSYLPENRAVITPQGVTNWTYQELEATHQALTREGYVFVGYHGTNH
VAAQTIVNRIAPVPRGNNTENEEKWGGLYVATHAEVAHGYARIKEGTGEY
GLPTRAERDARGVMLRVYIPRASLERFYRTNTPLENAEEHITQVIGHSLPLR
NEAFTGPESAGGEDETVIGWDIAIHAVAIPSTIPGNAYEELAIDEEAVAKEQS
ISTKPPYKERKDELK

SEQ ID NO: 44    VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
KTQGNVSFSVTRPEHNIAISWPSVSYKAAQKEGSRHKRWAHWHTGLALC
WLVPIDAIYNYITQQNCTLGDNWFGGSYETVAGTPKAITVKQGIEQKPVEQ
RIHFSKKNAMEALAAHRVCGVPLETLARSRKPRDLPDDLSCAYQAQNIVSL
FVATRILFSHLDSVFTLNLDEQEPEVAERLSALRQINENNPGMVTQVLTVAR
QIYNDYVTHHPGLTPEQTSAGAQAADILSLFCPDADKPCVASNNDQANINV
ESRSGRSYLPENRAVITPQGVTNWTYQELEATHQALTREGYVFVGYHGTN
HVAAQTIVNRIAPVPRGNNTENEEKWGGLYVATHAEVAHGYARIKEGTGE

TABLE 2-continued

Additional cholix polypeptides

SEQ ID NO: 45
YGLPTRAEREARGVMLRVYIPRASLERFYRTNTPLENAERHITQVIGHSLPL
RNEAFTGPESAGGEDETVIGWDMAIHAVAIPSTIPGNAYEELAIDEEAVAKE
QSISAKPPYKERKDELK

VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
KTQGNVSFSVTRPEHNIAISWPSVSYKAAQKEGSRHKRWAHWHTGLALC
WLVPIDAIYNYITQQNCTLGDNWFGGSYETVAGTPKAITVKQGIEQKPVEQ
RIHFSKKNAMETLAAHRVCGVPLETLARSRKPRDLPDDLSCAYQAQNIVSL
FVATRILFSHLDSVFTLNLDEQEPEVAERLSALRQINENNPGMVTQVLTVAR
QIYNDYVTHHPGLTPEQTSAGAQAADILSLFCPDADKPCVASNNDQANINV
ESRSGRSYLPENRAVITPQGVTNWTYQELEATHQALTREGYVFVGYHGTN
HVAAQTIVNRIAPVPRGNNTENEEKWGGLYVATHAEVAHGYARIKEGTGE
YGLPTRAEREARGVMLRVYIPRASLERFYRTNTPLENAERHITQVIGHSLPL
RNEAFTGPESAGGEDETVIGWDMAIHAVAIPSTIPGNAYEELAIDEEAVAKE
QSISAKPPYKERKDELK

SEQ ID NO: 46
VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
KTQGNVSFSVTRPEHNIAISWPSVSYKAAQKEGSRHKRWAHWHTGLALC
WLVPIDAIYNYITQQNCTLGDNWFGGSYETVAGTPKAITVKQGIEQKPVEQ
RIHFSKKNAMEALAAHRVCGVPLETLARSRKPRDLPDDLSCAYQAQNIVSL
FVATRILFSHLDSVFTLNLDEQEPEVAERLSALRQINENNPGMVTQVLTVAR
QIYNDYVTHHPGLTPEQTSAGAQAADILSLFCPDADKPCVASNNDQANINV
ESRSGRSYLPENRAVITPQGVTNWTYQELEATHQALTREGYVFVGYHGTN
HVAAQTIVNRIAPVPRGNNTENEEKWGGLYVATHAEVAHGYARIKEGTGE
YGLPTRAEREARGVMLRVYIPRASLERFYRTNTPLENAERHITQVIGHSLPL
RNEAFTGPESAGGEDETVIGWDMAIHAVAIPSTIPGNAYEELAIDEEAVAKE
QSISAKPPYKEQKDELK

SEQ ID NO: 47
VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
KTQGNVSFSVTRPEHNIAISWPSVSYKAAQKEGSRHKRWAHWHTGLALC
WLVPIDAIYNYITQQNCTLGDNWFGGSYETVAGTPKAITVKQGIEQKPVEQ
RIHFSKKNAMETLAAHRVCGVPLETLARSRKPRDLPDDLSCAYQAQNIVSL
FVATRILFSHLDSVFTLNLDEQEPEVAERLSALRQINENNPGMVTQVLTVAR
QIYNDYVTHHPGLTPEQTSAGAQAADILSLFCPDADKPCVASNNDQANINV
ESRSGRSYLPENRAVITPQGVTNWTYQELEATHQALTREGYVFVGYHGTN
HVAAQTIVNRIAPVPRGNNTENEEKWGGLYVATHAEVAHGYARIKEGTGE
YGLPTRAEREARGVMLRVYIPRASLERFYRTNTPLENAERHITQVIGHSLPL
RNEAFTGPESAGGEDETVIGWDMAIHAVAIPSTIPGNAYEELAIDEEAVAKE
QSISAKPPYKEQKDELK

SEQ ID NO: 48
VEDELNIFDECRSPCLLTPEPGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
ENQGNVSFAVTRPEQSIAISWPSVSYKAAHKNGSRHKRWAHWHTGLALC
WLVPIDAIYNYITQQNCTLGDNWFGGSYETVAGTPKAITVKQGIEQKPVEQ
RIHFSKKNAMEALAAHRVCGVPLETLARSRKPRDLPDDLSCAYQAQNIVSL
FVATRILFSHLDSVFTLNLDEQEPEVAERLSALRQINENNPGMVTQVLTVAR
QIYNDYVTHHPGLTPEQTSAGAQAADILSLFCPDADKPCVASNNDQANINV
ESRSGRSYLPENRAVITPQGVTNWTYQELEATHQALTREGYVFVGYHGTN
HVAAQTIVNRIAPVPRGNNTENEEKWGGLYVATHAEVAHGYARIKEGTGE
YGLPTRAEREARGVMLRVYIPRASLERFYRTNTPLENAERHITQVIGHSLPL
RNEAFTGPESAGGEDETVIGWDMAIHAVAIPSTIPGNAYEELAIDEEAVAKE
QSISAKPPYKEQKDELK

SEQ ID NO: 49
VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVIPGEDSPASIKISVDELDQQRNIIEVPKLYSIDLDNQTLEQW
KTQGNVSFSVTRPEHNIAISWPSVSYKAAQKEGSRHKRWAHWHTGLALC
WLVPIDAIYNYITQQNCTLGDNWFGGSYETVAGTPKAITVKQGIEQKPVEQ
RIHFSKKNAMETLAAHRVCGVPLETLARSRKPRDLPDDLSCAYQAQNIVSL
FVATRILFSHLDSVFTLNLDEQEPEVAERLSALRQINENNPGMVTQVLTVAR
QIYNDYVTHHPGLTPEQTSAGAQAADILSLFCPDADKPCVASNNDQANINV
ESRSGRSYLPENRAVITPQGVTNWTYQELEATHQALTREGYVFVGYHGTN
HVAAQTIVNRIAPVPRGNNTENEEKWGGLYVATHAEVAHGYARIKEGTGE
YGLPTRAEREARGVMLRVYIPRASLERFYRTNTPLENAERHITQVIGHSLPL
RNEAFTGPESAGGEDETVIGWDMAIHAVAIPSTIPGNAYEELAIDEEAVAKE
QSISAKPPYKERKDELK

SEQ ID NO: 50
VEDELNIFDECRSPCSLTPEPGKPIQSKLSIPSDVVLDEGVLYYSMTINDEQN
DIKDEDKGESIITIGEFATVRATRHYVSQDAPFGVINLDITTENGTKTYSFNR
KESEFAINWLVPIGEDSPASIKISVDELDQQRNIIEVPKLYSIDLDNQTLEQW
ETQGNVSFAVTRPEQSIAISWPSVSYKAAHKNGSRHKRWANWFTTSPKVTL

TABLE 2-continued

| Additional cholix polypeptides | |
|---|---|
| | CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREDYVFVGYHGTNHVAAQTI VNRIAPVPRGNNTENEEKWGGLYVATHAEVAHGYARIKEGTGEYGLPTRA EQETRGVMLRVYIPRASLERFYRTNTPLENAEEHITQVIGHSLPLRNEAFTG PESAGGEDETVIGWDMAIHAVAIPSTIPGNAYEGLTTDEEAVVKEAIAKEQS ISAKPPYKERKDELK |
| SEQ ID NO: 51 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW ENQGNVSFAVTRPEQSIAISWPSVSYKAAHKNGSRHKRWANWFTTSPKVT LCFYEDPAQCTYGDDWHGGAYKTVAGTPKAITVKQGIEQKTVEQRIHFSQ KNAMEALAAHRVCGVPLETLARSRKPRDLPDDLSCAYQAQNIVSLFVATRI LFSHLDSVFTLNLDEQEPEVAERLSALRQINENNPGMVTQVLTVARQIYND YVTHHPGLTPEQTSAGAQAADILSLFCPDADKSCVASNNDQANINIESRSGR SYLPENRAVITPQGVTNWTYQELEATHQALTREDYVFVGYHGTNHVAAQT IVNRIAPVPRGNNTENEEKWGGLYVATHAEVAHGYARIKEGTGEYGLPTR AEQETRGVMLRVYIPRASLERFYRTNTPLENAEEHITQVIGHSLPLRNEAFT GPESAGGEDETVIGWDMAIHAVAIPSTIPGNAYEGLTTDEEAVVKEAIAKE QSISAKPPYKEQKDELK |
| SEQ ID NO: 52 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDEIDQQRNIIEVPKLYSIDLDNQTLEQWE NQGNVSFAVTRPEQSIAISWPSVSYKAAHKNGSRHKRWANWFTTSPKVTL CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREDYVFVGYHGTNHVAAQTI VNRIAPVPRGNNTENEEKWGGLYVATHAEVAHGYARIKEGTGEYGLPTRA EQETRGVMLRVYIPRASLERFYRTNTPLENAEEHITQVIGHSLPLRNEAFTG PESAGGEDETVIGWDMAIHAVAIPSTIPGNAYEGLTTDEEAVVKEAIAKEQS ISAKPPYKERKDELK |
| SEQ ID NO: 53 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDEIDQQRNIIEVPKLYSIDLDNQTLEQWE NQGNVSFAVTRPEQSIAISWPSVSYKAAHKNGSRHKRWANWFTTSPKVTL CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREGYVFVGYHGTNHVAAQTI VNRIAPVPRGNNTENEEKWGGLYVATHAEVAHGYARIKEGTGEYGLPTRA EQETRGVMLRVYIPRASLERFYRTNTPLENAEEHITQVIGHSLPLRNEAFTG PESAGGEDETVIGWDMAIHAVAIPSTIPGNAYEGLTTDEEAVVKEAIAKEQS ISAKPPYKEQKDELK |
| SEQ ID NO: 54 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDEIDQQRNIIEVPKLYSIDLDNQTLEQWE NQGNVSFAVTRPEQSIAISWPSVSYKAAHKNGSRHKRWANWFTTSPKVTL CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREDYVFVGYHGTNHVAAQTI VNRIAPVPRGNNTENEEKWGGLYVATHAEVAHGYARIKEGTGEYGLPTRA EQETRGVMLRVYIPRASLERFYRTNTPLENAEEHITQVIGHSLPLRNEAFTG PESAGGEDETVIGWDMAIHAVAIPSTIPGNAYEGLTTDEEAVVKEAIAKEQS ISAKPPYKEQKDELK |
| SEQ ID NO: 55 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDEIDQQRNIIEVPKLYSIDLDNQTLEQWE NQGNVSFAVTRPEQSIAISWPSVSYKAAHKNGSRHKRWANWFTTSPKVTL CFYEDPAQCTYGDDWHGGAYKTVAGIPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREDYVFVGYHGTNHVAAQTI VNRIAPVPRGNNTENEEKWGGLYVATHAEVAHGYARIKEGTGEYGLPTRA |

TABLE 2-continued

| Additional cholix polypeptides | |
|---|---|
| | EQETRGVMLRVYIPRASLERFYRTNTPLENAEEHITQVIGHSLPLRNEAFTG PESAGGEDETVIGWDMAIHAVAIPSTIPGNAYEGLTTDEEAVVKEAIAKEQS ISAKPPYKERKDELK |
| SEQ ID NO: 56 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDEIDQQRNIIEVPKLYSIDLDNQTLEQWE NQGNVSFAVTRPEQSIAISWPSVSYKAAHKNGSRHKRWANWFTTSPKVTL CFYEDPAQCTYGDDWHGGAYKTVAGIPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREDYVFVGYHGTNHVAAQTI VNRIAPVPRGNNTENEEKWGGLYVATHAEVAHGYARIKEGTGEYGLPTRA EQETRGVMLRVYIPRASLERFYRTNTPLENAEEHITQVIGHSLPLRNEAFTG PESAGGEDETVIGWDMAIHAVAIPSTIPGNAYEGLTTDEEAVVKEAIAKEQS ISAKPPYKEQKDELK |
| SEQ ID NO: 57 | VEDELNIFDECRSPCSLTPEPGKPIQSKLSIPGDVVLDEGVLYYSMTINDEQN DIKDEDKGESIITIGEFATVRATRHYVSQDAPFGVINLDITTENGTKTYSFNR KESEFAINWLVPIGEDSPASIKISIDELDQQRNIIEVPKLYSIDLDNQTLEQWE NQGNVSFAVTRPEQSIAISWPSVSYKAAHKNGSRHKRWANWLTTLPEVVL CFFEDPELCTYGDDWHGGAYKTVAGTPKAITVKQGIEQKTVEQRIHFSKKN AMEALAAHRVCGVPLETLARSRKPRDLPDDLSCAYNAQQIVSLFLATRILF THIDSIFTLNLDGQEPEVAERLDDLRRINENNPGMVIQVLTVARQIYNDYVT HHPGLTPEQTSAGAQAADILSLFCPDADKSCVASNSDQANINIESRSGRSYL PENRAVITQQGVTNWTYQELEATHQALTQEGYVFVGYHGTNHVAAQTIV NRIAPVPRGNNTENEEKWGGLYVATHAEVAHGYARIKEGTGEYGLPTRAE QETRGVMLRVYIPRASLERFYRTNTPLENAEEHITQVIGHSLPLRNEAFTGP ESAGGEDETVIGWDMAIHAVAIPSTIPGNAYEGLTTDEEAVVKEAIAKEQSI SAKPPYKEQKDELK |
| SEQ ID NO: 58 | VEDELNIFDECRSPCSLTPEPGKPIQSKLSIPGDVVLDEGVLYYSMTINDEQN DIKDEDKGESIITIGEFATVRATRHYVNQDAPFGVIHLDITTENGTKTYSFNR KEGEFAINWLVPIGEDSPASIKISIDELDQQRNIIEVPKLYSIDLDNQTLEQWE TQGNVSFAVTRPEQSIAISWPSVSYKAAQKDGARHKRWAHWHTGLALCW LVPLDAIYNYITQQNCTLGDNWFGGSYETVAGTPKAITVKQGMEQKPVEQ RIHFSKKNAMEALAAHRVCGVPLETLARGRKPRDLTDDLQCAYQAQNIVS LFLATRILFSHLDSVFTLNLDEQEPEVAERLTDLRRINENNPGMVTQVLTIA RQIYNDYVTEHPGLTPEQTSAGAQAADILSLFCPDADESCVASNSDQANINI ESRSGRSYLPENRAVITPQGVTNWTYQELEAKHQTLTREGYVFVGYHGTN HVAAQSIVNRITPVPRGNNTEKEEEWGGVYVATHAELAHRYARIKEGTGE NGLPTTEEKKSRGVMLRVYLPRASLERFYRTNIPLENADEHVTQVIGHPLPL RNEAFTGPESAGGEDETAIGWDMAIHGVAIPSTIPGNSYAQLPIDEEAVAKE QSISAKPPYKEHDELK |
| SEQ ID NO: 59 | VEDELNIFDECRSPCSLTPEPGKPIQSKLSIPGDVVLDEGVLYYSMTINDEQN DIKDEDKGESIITIGEFATVRATRHYVNQDAPFGVIHLDITTENGTKTYSFNR KEGEFAINWLVPIGEDSPASIKISIDELDQQRNIIEVPKLYSIDLDNQTLEQWE TQGNVSFAVTRPEQSIAISWPSVSYKAAQKDGARHKRWAHWHTGLALCW LVPLDAIYNYITQQNCTLGDNWFGGSYETVAGTPKAITVKQGMEQKPVEQ RIHFSKKNAMEALAAHRVCGVPLETLARGRKPRDLTDDLQCAYQAQNIVS LFLATRILFSHLDSVFTLNLDEQEPEVAERLTDLRRINENNPGMVTQVLTIA RQIYNDYVTEHPGLTPEQTSAGAQAADILSLFCPDADESCVASNSDQANINI ESRSGRSYLPENRAVITPQGVTNWTYQELEAKHQTLTREGYVFVGYHGTN HVAAQSIVNRITPVPRGNNTEKEEEWGGVYVATHAEVNHRYARIKEGTGE NGLPTTEEKKSRGVMLRVYLPRASLERFYRTNIPLENADEHVTQVIGHPLPL RNEAFTGPESAGGEDETAIGWDMAIHGVAIPSTIPGNSYAQLPIDEEAVAKE QSISAKPPYKEHDELK |
| SEQ ID NO: 60 | VEDELNIFDECRSPCSLTPEPGKPIQSKLSIPGDVVLDEGVLYYSMTINDEQN DIKDEDKGESIITIGEFATVRATRHYVNQDAPFGVIHLDITTENGTKTYSFNR KEGEFAINWLVPIGEDSPASIKISIDELDQQRNIIEVPKLYSIDLDNQTLEQWE TQGNVSFAVTRPEQSIAISWPSVSYKAAQKDGARHKRWAHWHTGLALCW LVPLDAIYNYITQQNCTLGDNWFGGSYETVAGTPKAITVKQGMEQKPVEQ RIHFSKKNAMEALAAHRVCGVPLETLARGRKPRDLTDDLQCAYQAQNIVS LFLATRILFSHLDSVFTLNLDEQEPEVAERLTDLRRINENNPGMVTQVLTIA RQIYNDYVTEHPGLTPEQTSAGAQAADILSLFCPDADESCVASNSDQANINI ESRSGRSYLPENRAVITPQGVTNWTYQELEAKHQTLTREGYVFVGYHGTN HVAAQSIVNRITPVPRGNNTEKEEEWGGVYVATHAELAHRYARIKEGTGE NGLPTTEKKKSRGVMLKVYLPRASLERFYRTNIPLENADEHVTQVIGHPLP LRNEAFTGPESAGGENETAIGWDMAIHGVAIPSTIPGNSYAQLPIDEEAVAK EQSISAKPPYKEHDELK |
| SEQ ID NO: 61 | VEDELNIFDECRSPCSLTPELGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDEIDQQRNIIEVPKLYSIDLDNQTLEQWE NQGNVSFAVTRPEQSIAISWPSVSYKAAHKNGSRHKRWANWFTTSPKVTL |

TABLE 2-continued

| Additional cholix polypeptides | |
|---|---|
| | CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREDYVFVGYHGTNHVAAQTI VNRIAPVPRGNNTENEEKWGGLYVATHAEVAHGYARIKEGTGEYGLPTRA EQETRGVMLRVYIPRASLERFYRTNTPLENAEEHITQVIGHSLPLRNEAFTG PESAGGEDETVIGWDMAIHAVAIPSTIPGNAYEGLTTDEEAVVKEAIAKEQS ISAKPPYKEQKDELK |
| SEQ ID NO: 62 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVIPGEDSPASIKISVDEIDQQRNIIEVPKLYSIDLDNQTLEQWE NQGNVSFAVTRPEQSIAISWPSVSYKAAHKNGSRHKRWANWFTTSPKVTL CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREDYVFVGYHGTNHVAAQTI VNRIAPVPRGNNTENEEKWGGLYVATHAEVAHGYARIKEGTGEYGLPTRA EQETRGVMLRVYIPRASLERFYRTNTPLENAEEHITQVIGHSLPLRNEAFTG PESAGGEDETVIGWDMAIHAVAIPSTIPGNAYEGLTTDEEAVVKEAIAKEQS ISAKPPYKERKDELK |
| SEQ ID NO: 63 | VEDELNIFDECRSPCSLTPEPGKPIQSKLSIPGDVVLDEGVLYYSMTINDEQN DIKDEDKGESIITIGEFATVRATRHYVNQDAPFGVIHLDITTENGTKTYSFNR KEGEFAINWLVIPGEDSPASIKISIDELDQQRNIIEVPKLYSIDLDNQTLEQWE TQGNVSFAVTRPEQSIAISWPSVSYKAAQKDGARHKRWAHWHTGLALCW LVPLDAIYNYITQQNCTLGDNWFGGSYETVAGTPKAITVKQGMEQKPVEQ RIHFSKKNAMEALAAHRVCGVPLETLARGRKPRDLTDDLQCAYQAQNIVS LFLATRILFSHLDSVFTLNLDEQEPEVAERLTDLRRINENNPGMVTQVLTIA RQIYNDYVTEHPGLTPEQTSAGAQAADILSLFCPDADESCVASNSDQANINI ESRSGRSYLPENRAVITPQGVTNWTYQELEAKHQTLTREGYVFVGYHGTN HVAAQSIVNRITPVPRGNNTEKEEEWGGVYVATHAELAHRYARIKEGTGE NGLPTTEEKKSRGVMLRVYLPRASLERFYRTNIPLENADEHVTQVIGHPLPL RNEAFTGPESAGGEDETAIGWDMAIHGVAIPSTIPGNSYAQLPIDEEAVAKE QSISAKPPYKEHDELK |
| SEQ ID NO: 64 | VEDELNIFDECRSPCSLTPEPGKPIQSKLSIPSDVVLDEGVLYYSMTINDEQN DIKDEDKGESIITIGEFATVRATRHYVSQDAPFGVINLDITTENGTKTYSFNR KESEFAINWLVPIGEDSPASIKISVDELDQQRNIIEVPKLYSIDLDNQTLEQW ETQGNVSFAVTRPEQSIAISWPSVSYKAAHKNGSRHKRWANWFTTSPKVTL CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREGYVFVGYHGTNHVAAQTI VNRIAPVPRGNNTENEEKWGGLYVATHAEVAHGYARIKEGTGEYGLPTRA ERDARGVMLRVYIPRASLERFYRTNTPLENAEEHITQVIGHSLPLRNEAFTG PESAGGEDETVIGWDMAIHAVAIPSTIPGNAYEELAIDEEAVAKEQSISTKPP YKERKDELK |
| SEQ ID NO: 65 | VEDELNIFDECRSPCSLTPEPGKPIQSKLSIPSDVVLDEGVLYYSMTINDEQN DIKDEDKGESIITIGEFATVRATRHYVSQDAPFGVINLDITTENGTKTYSFNR KESEFAINWLVPIGEDSPASIKISVDELDQQRNIIEVPKLYSIDLDNQTLEQW ETQGNVSFAVTRPEQSIAISWPSVSYKAAHKNGSRHKRWANWFTTSPKVTL CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREDYVFVGYHGTNHVAAQTI VNRIAPVPRGNNTENEEKWGGLYVATHAEVAHGYARIKEGTGEYGLPTRA ERDARGVMLRVYIPRASLERFYRTNTPLENAEEHITQVIGHSLPLRNEAFTG PESAGGEDETVIGWDMAIHAVAIPSTIPGNAYEELAIDEEAVAKEQSISTKPP YKERKDELK |
| SEQ ID NO: 66 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW KTQGNVSFSVTRPEQSIAISWPSVSYNAAHKNGSRHKRWANWFTTSPKVTL CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY |

TABLE 2-continued

| Additional cholix polypeptides | |
|---|---|
| | VTHHPGLTPEQTSAGAQAADILSLFCPDADKSCVASNNDQANINVESRSGR SYLPENRAVITPQGVTNWTYQELEATHQALTREGYVFVGYHGTNHVAAQT IVNRIAPVPRGNNTENEEKWGGLYVATHAEVAHGYARIKEGTGEYGLPTR AERDARGVMLRVYIPRASLERFYRTNTPLENAEEHITQVIGHSLPLRNEAFT GPESAGGEDETVIGWDMAIHAVAIPSTIPGNAYEELAIDEEAVAKEQSISTKP PYKERKDELK |
| SEQ ID NO: 67 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW ENQGNVSFAVTRPEQSIAISWPSVSYKAAHKNGSRHKRWANWLTTLPKVV LCFYEDPELCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREGYVFVGYHGTNHVAAQTI VNRIAPVPRGNNTENEEKWGGLYVATHAEVAHGYARIKEGTGNGGLPTRA ERDARGVMLRVYIPRASLERFYRTNTPLENAEEHITQVIGHSLPLRNEAFTG PESAGGEDETVIGWDMAIHAVAIPSTIPGNAYEELAIDEEAVAKEQSISAKPP YKEQKDELK |
| SEQ ID NO: 68 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDEIDQQRNIIEVPKLYSIDLDNQTLEQWE NQGNVSFAVTRPEQSIAISWPSVSYKAAHKNGSRHKRWANWFTTSPKVTL CFYEDPAQCTYGDDWHGGAYKTVAGTPKAITVKQGIEQKTVEQRIHFSKK NAMEALAAHRVCGVPLETLARSRKPRDLPDDLSCAYQAQNIVSLFVATRIL FSHLDSVFTLNLDEQEPEVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREGYVFVGYHGTNHVAAQTI VNRIAPVPRGNNTENEEKWGGLYVATHAEVAHGYARIKEGTGEYGLPTRA ERDARGVMLRVYIPRASLERFYRTNTPLENAEEHITQVIGHSLPLRNEAFTG PERVDGEDETVIGWDMAIHAVAIPSTIPGNAYEELAIDEEAVAKEQSISTKPP YKERKDELK |
| SEQ ID NO: 69 | VEDELNIFDECRSPCSLTPEPGKPIQSKLSIPSDVVLDEGVLYYSMTINDEQN DIKDEDKGESIITIGEFATVRATRHYVNQDAPFGVINLDITTENGTKMYSYN RKEGEFAINWLVPIGEDSPASIKISVDEIDQQRNIIEVPKLYSIDLDNQTLEQW ENQGNVSFAVTRPEQSIAISWPSVSYKAAHKNGSRHKRWANWFTTSPKVT LCFYEDPAQCTYGDDWHGGAYKTVAGTPKAITVKQGIEQKTVEQRIHFSK KNAMEALAAHRVCGVPLETLARSRKPRDLPDDLSCAYQAQNIVSLFVATRI LFSHLDSVFTLNLDEQEPEVAERLSALRQINENNPGMVTQVLTVARQIYND YVTHHPGLTPEQTSAGAQAADILSLFCPDADKSCVASNNDQANINIESRSGR SYLPENRAVITPQGVTNWTYQELEATHQALTREGYVFVGYHGTNHVAAQT IVNRIAPVPRGNNTENEEKWGGLYVATHAEVAHGYARIKEGTGEYGLPTR AERDARGVMLRVYIPRASLERFYRTNTPLENAEEHITQVIGHSLPLRNEAFT GPERVDGEDETVIGWDMAIHAVAIPSTIPGNAYEELAIDEEAVAKEQSISTK PPYKERKDELK |
| SEQ ID NO: 70 | VEDELNIFDECRSPCSLTPEPGKPIQSKLSIPSDVVLDEGVLYYSMTINDEQN DIKDEDKGESIITIGEFATVRATRHYVNQDAPFGVIHLDITTENGTKTYSYNR KEGEFAINWLVPIGEDSPASIKISVDELDQKRNIIEVPKLYSIDLDNQTLEQW ENQGNVSFAVTRPEQSIAISWPSVSYKAAHKNGSRHKRWANWLTTLPKVV LCFYEEPELCTYGEDWHGGAYKTVAGTPEAITVKQGIEQKTVEQRIHFSKK NAMEALAAHRVCGVPLETLARSRKPRDLQDDLSCAYQAQNIVSLFVATRIL FSHLDSVFTLNLDEQEPAVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREGYVFVGYHGTNHVAAQTI VNRIAPVPRGNNTENEEKWGGLYVATHAEVAHGYARIKEGTGEYGLPTRA ERDARGVMLRVYIPRASLERFYRTNTPLENAEEHITQVIGHSLPLRNEAFTG PESAGGEDETVIGWDMAIHAVAIPSTIPGNAYEELAIDEEAVAKEQSISAKPP YKEQKDELK |
| SEQ ID NO: 71 | VEDELNIFDECRSPCSLTPEPGKPIQSKLSIPGDVVLDEGVLYYSMTINDEQN DIKDEDKGESIITIGEFATVRATRHYVSQDAPFGVINLDITTENGTKTYSFNR KESEFAINWLVPIGEDSPASIKISIDELDQQRNIIEVPKLYSIDLDNQTLEQWE NQGNVSFAVTRPEQSIAISWPSVSYKAAHKNGSRHKRWANWLTTLPEVVL CFFEDPELCTYGDDWHGGAYKTVAGTPKAITVKQGIEQKTVEQRIHFSKKN AMEALAAHRVCGVPLETLARSRKPRDLPDDLSCAYNAQQIVSLFLATRILF THIDSIFTLNLDGQEPEVAERLDDLRRINENNPGMVIQVLTVARQIYNDYVT HHPGLTPEQTSAGAQAADILSLFCPDADKSCVASNSDQANINIESRSGRSYL PENRAVITQQGVTNWTYQELEATHQALTQEGYVFVGYHGTNHVAAQSIVN RISPVPRGSDTESERAWGGLYVSTDASVAYGYARIQEGTADGGGLTPAERK ARGVMLRVYLPQASLERFYRINADLEKERNLVERVIGHPLPLRNEAFTGTD AEEGSDETAIGWDMAIHGVAIPSTIPGNSYAQLPIDEEAVAKEQSISAKPPYK EQKDELK |

TABLE 2-continued

Additional cholix polypeptides

SEQ ID NO: 72

VEDELNIFDECRSPCSLTPEPGKPIQSKLSIPGDVVLDEGVLYYSMTINDEQN
DIKDEDKGESIITIGEFATVRATRHYVSQDAPFGVINLDITTENGTKTYSFNR
KESEFAINWLVPIGEDSPASIKISIDELDQQRNIIEVPKLYSIDLDNQTLEQWE
NQGNVSFAVTRPEQSIAISWPSVSYKAAHKNGSRHKRWANWLTTLPEVVL
CFFEDPELCTYGDDWHGGAYKTVAGTPKAITVKQGIEQKTVEQRIHFSKKN
AMEALAAHRVCGVPLETLARSRKPRDLPDDLSCAYNAQQIVSLFLATRILF
THIDSIFTLNLDGQEPEVAERLDDLRRINENNPGMVIQVLTVARQIYNDYVT
HHPLLTPEQTSAGAQAADILSLFCPDADKSCVASNSDQANINIESRSGRSYL
PENRAVITQQGVTNWTYQELEATHQALTQEGYVFVGYHGTNHVAAQSIVN
RISPVPRGSDTESERAWGGLYVSTDASVAYGYARIQEGTADGGGLTPAERK
ARGVMLRVYLPQASLERFYRINADLEKERNLVERVIGHPLPLRNEAFTGTD
AEEGSDETAIGWDMAIHGVAIPSTIPGNSYAQLPIDEEAVAKEQSISAKPPYK
EQKDELK

SEQ ID NO: 73

VEDELNIFDECRSPCSLTPEPGKPIQSKLSIPGDVVLDEGVLYYSMTINDEQN
DIKDEDKGESIITIGEFATVRATRHYVNQDAPFGVINLDITTENGTKTYSFNR
KESEFAINWLVPIGEDSPASIKISIDELDQQRNIIEVPKLYSIDLDNQTLEQWE
NQGNVSFAVTRPEQSIAISWPSVSYKAAHKNGSRHKRWANWLTTLPEVVL
CFFEDPELCTYGDDWHGGAYKTVAGTPKAITVKQGIEQKTVEQRIHFSKKN
AMEALAAHRVCGVPLETLARSRKPRDLPDDLSCAYNAQQIVSLFLATRILF
THIDSIFTLNLDGQEPEVAERLDDLRRINENNPGMVIQVLTVARQIYNDYVT
HHPGLTPEQTSAGAQAADILSLFCPDADKSCVASNSDQANINIESRSGRSYL
PENRAVITQQGVTNWTYQELEATHQALTQEGYVFVGYHGTNHVAAQSIVN
RISPVPRGSDTESERAWGGLYVSTDASVAYGYARIQEGTADGGGLTPAERK
ARGVMLRVYLPQASLERFYRINADLEKERNLVERVIGHPLPLRNEAFTGTD
AEEGSDETAIGWDMAIHGVAIPSTIPGNSYAQLPIDEEAVAKEQSISAKPPYK
EQKDELK

SEQ ID NO: 74

VEDELNIFDECRSPCSLTPEPGKPIQSKLFIPGDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
ENQGNVSFAVTRPEQSIAISWPSVSYKAAHKNGSRHKRWANWLTTLPKVV
LCFYEDPELCTYGDDWHGGAYKTVAGTPKAITVKQGIEQKTVEQRIHFSKK
NAIEALAAHRVCGVPLETLARSRKPRDLPDDLSCAYQAQNIVSLFVATRILF
SHLDSVFTLNLDEQEPAVAERLSALRQINENNPGMVTQVLTVARQIYNDYV
THHPGLTPEQTSAGAQAADILSLFCPDADKSCVASNNDQANINIESRSGRSY
LPENRAVITPQGVTNWTYQELEATHQALTREGYVFVGYHGTNHVAAQTIV
NRIAPVPRGNNTENEEKWGGLYVATHAEVAHGYARIKEGTGEYGLPTRAE
RDARGVMLRVYIPRASLERFYRTNTPLENAEEHITQVIGHSLPLRNEAFTGP
ESAGGEDETVIGWDMAIHAVAIPSTIPGNAYEELAIDEEAVAKEQSISTKPPY
KERKDELK

SEQ ID NO: 75

VEDELNIFDECRSPCSLTPELGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDEIDQQRNIIEVPKLYSIDLDNQTLEQWE
NQGNVSFAVTRPEQSIAISWPSVSYKAAHKNGSRHKRWANWFTTSPKVTL
CFYEDPAQCTYGDDWYGGAYKTVAGTPKAITVKQGIEQKTVEQRIHFSKK
NAMEALAAHRVCGVPLETLARSRKPRDLPDDLSCAYQAQNIVSLFVATRIL
FSHLDSVFTLNLDEQEPEVAERLSALRQINENNPGMVTQVLTVARQIYNDY
VTHHPGLTPEQTSAGAQAADILSLFCPDTDKSCVASNNDQANINIESRSGRS
YLPENRAVITPQGVTNWTYQELEATHQALTREDYVFVGYHGTNHVAAQTI
VNRIAPVPRGNNTENEEKWGGLYVATHAEVAHGYARIKEGTGEYGLPTRA
ERDARGVMLRVYIPRASLERFYRTNTPLENAEEHITQVIGHSLPLRNEAFTG
PESAGGEDETVIGWDMAIHAVAIPSTIPGNAYEELAIDEEAVAKEQSISTKPP
YKERKDELK

SEQ ID NO: 76

VEDELKIFDECRSPCSLTPEPGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
ENQGNVSFAVTRPEQSIAISWPSVSYKAAHKNGSRHKRWANWLTTLPKVV
LCFYEDPELCTYGDDWHGGAYKTVAGTPKAITVKQGIEQKTVEQRIHFSKK
NAMEALAAHRVCGVPLETLARSRKPRDLTDDLSCAYQAQNIVSLFVATRIL
FSHLDSVFTLNLDEQEPEVAERLSALRQINENNPGMVTQVLTVARQIYNDY
VTHHPGLTPEQTSAGAQAADILSLFCPDADKSCVASNNDQANINIESRSGRS
YLPENRAVITPQGVTNWTYQELEATHQALTREGYVFVGYHGTNHVAAQTI
VNRIAPVPRGNNTENEEKWGGLYVATHAEVAHGYARIKEGTGEYGLPTRA
ERDARGVMLRVYIPRASLERFYRTNTPLENAEEHITQVIGHSLPLRNEAFTG
PESAGGEDETVIGWDMAIHAVAIPSTIPGNAYEELAIDEEAVAKEQSISAKPP
YKEQKDELK

SEQ ID NO: 77

VEDELKIFDECRSPCSLTPEPGKPIQSKLSIPSDVVLDEGVLYYSMTINDEQN
DIKDEDKGESIITIGEFATVRATRHYVNQDAPFGVINLDITTENGTKTYSYNR
KEGEFAINWLVPIGEDSPASIKISVDELDQQRNIIEVPKLYSIDLDNQTLEQW
ENQGNVSFAVTRPEQSIAISWPSVSYKAAHKNGSRHKRWANWLTTLPKVV
LCFYEDPELCTYGDDWHGGAYKTVAGTPKAITVKQGIEQKTVEQRIHFSKK
NAMEALAAHRVCGVPLETLARSRKPRDLPDDLSCAYQAQNIVSLFVATRIL
FSHLDSVFTLNLDEQAPEVAERLSDLRRINEDNPGMVTQVLTVARQIYNDY

TABLE 2-continued

| Additional cholix polypeptides | |
|---|---|
| | VTHHPGLTPEQTSAGAQAADILSLFCPDADKSCVASNNDQANINIESRSGRS<br>YLPENRAVITPQGVTNWTYQELETTHQALTREGYVFVGYHGTNHVAAQTI<br>VNRIAPVPRGNNTENEEKWGGLYVATHAEVAHGYARIKEGTGEYGLPTRA<br>ERETRGVMLRVYIPRASLERFYRTNTPLENAEEHITQVIGHSLPLRNEAFTGP<br>ESAGGEDETVIGWDMAIHAVAIPSTIPGNAYEELAIDEEAVAKEQSISAKPP<br>YKEQKDELK |
| SEQ ID NO: 78 | VEDELKIFDECRSPCSLTPEPGKPIQSKLSIPSDVVLDEGVLYYSMTINDEQN<br>DIKDEDKGESIITIGEFATVRATRHYVNQDAPFGVINLDITTENGTKTYSYNR<br>KEGEFAINWLVPIGEDSPASIKISVDELDQQRNIIEVPKLYSIDLDNQTLEQW<br>ENQGNVSFAVTRPEQSIAISWPSVSYKAAHKNGSRHKRWANWLTTLPKVV<br>LCFYEDPELCTYGDDWHGGAYKTVAGTPKAITVKQGIEQKAVEQRIHFSK<br>KNAMEALAAHRVCGVPLETLARSRKPRDLPDDLSCAYQAQNIVSLFVATRI<br>LFSHLDSVFTLNLDEQEPEVAERLSALRQINENNPGMVTQVLTVARQIYND<br>YVTHHPGLTPEQTSAGAQAADILSLFCPDADKSCVASNNDQANINIESRSGR<br>SYLPENRAVITPQGVTNWTYQELEATHQALTREGYVFVGYHGTNHVAAQT<br>IVNRIAPVPRGNNTENEEKWGGLYVATHAEVAHGYARIKEGTGNGGLPTR<br>AERETRGVMLRVYIPRASLERFYRTNTPLENAEEHITQVIGHSLPLRNEAFT<br>GPESAGGEDETVIGWDMAIYAVAIPSTIPGNAYEELAIDEEAVAKEQSISAK<br>PPYKEQKDELK |
| SEQ ID NO: 79 | TPEPGKPIQSKLSIPGDVVLDEGVLYYSMTINDEQNDIKDEDKGESIITIGEFA<br>TVRATRHYVSQDAPFGVINLDITTENGTKTYSFNRKESEFAINWLVPIGEDS<br>PASIKISIDELDQQRNIIEVPKLYSIDLDNQTLEQWKTQGNVSFSVTRPEHNIA<br>ISWPSVSYKAAQKEGSRHKRWAHWHTGLALCWLVPIDAIYNYITQQNCTL<br>GDNWFGGSYETVAGTPKAITVKQGIEQKPVEQRIHFSKKNAMEALAAHRV<br>CGVPLETLARSRKPRDLPDDLSCAYNAQQIVSLFLATRILFTHIDSIFTLNLD<br>GQEPEVAERLDDLRRINENNPGMVIQVLTVARQIYNDYVTHHPGLTPEQTS<br>AGAQAADILSLFCPDADKSCVASNSDQANINIESRSGRSYLPENRAVITQQG<br>VTNWTYQELEATHQALTQEGYVFVGYHGTNHVAAQSIVNRISPVPRGSDT<br>ESERAWGGLYVSTDASVAYGYARIQEGTADGGGLTPAERKARGVMLRVY<br>LPQASLERFYRINADLEKERNLVERVIGHPLPLRNEAFTGTDAEEGSDETAI<br>GWDMAIHGVAIPSTIPGNSYAQLPIDEEAVAKEQSISAKPPYKEQKDELK |
| SEQ ID NO: 80 | SIPSDVVLDEGVLYYSMTINDEQNDIKDEDKGESIITIGEFATVRATRHYVN<br>QDAPFGVINLDITTENGTKTYSYNRKEGEFAINWLVPIGEDSPASIKISVDEL<br>DQQRNIIEVPKLYSIDLDNQTLEQWKTQGNVSFSVTRPEHNIAISWPSVSYK<br>AAQKEGSRHKRWAHWHTGLALCWLVPIDAIYNYITQQNCTLGDNWFGGS<br>YETVAGTPKAITVKQGIEQKPVEQRIHFSKKNAMEALAAHRVCGVPLETLA<br>RSRKPRDLPDDLSCAYQAQNIVSLFVATRILFSHLDSVFTLNLDEQEPEVAE<br>RLSALRQINENNPGMVTQVLTVARQIYNDYVTHHPGLTPEQTSAGAQAADI<br>LSLFCPDADKSCVASNNDQANINIESRSGRSYLPENRAVITPQGVTNWTYQE<br>LEATHQALTREGYVFVGYHGTNHVAAQTIVNRIAPVPRGNNTENEEKWGG<br>LYVATHAEVAHGYARIKEGTGEYGLPTRAERDARGVMLRVYIPRASLERF<br>YRTNTPLENAEEHITQVIGHSLPLRNEAFTGPESAGGEDETVIGWDMAIHAV<br>AIPSTIPGNAYEELAIDEEAVAKEQSISTKPPYKERKDELK |
| SEQ ID NO: 81 | MTINDEQNDIMDEGKGESIITIGEFATVRATRHYVNQDAPFGVINLDITTEN<br>GTKTYSYNRKEGEFAINWLVPIGEDSPASIKISVDELDQQRNIIEVPKLYSIDL<br>DNQTLEQWENQGNVSFAVTRPEQSIAKQSIAISWPSVSYKAAQKEGSRHKR<br>WAHWHTGLALCWLVPIDAIYNYITQQNCTLGDNWFGGSYETVAGTPKAIT<br>VKQGIEQKPVEQRIHFSKKNAMEALAAHRVCGVPLETLARSRKPRDLTDDL<br>SCAYQAQNIVSLFVATRILFSHLDSVFTLNLDEQEPEVAERLSALRQINENNP<br>GMVTQVLTVARQIYNDYVTHHPGLTPEQTSAGAQAADILSLFCPDADKSC<br>VASNNDQANINIESRSGRSYLPENRAVITPQGVTNWTYQELEATHQALTRE<br>GYVFVGYHGTNHVAAQTIVNRIAPVPRGNNTENEEKWGGLYVATHAEVA<br>HGYARIKEGTGEYGLPTRAERDARGVMLRVYIPRASLERFYRTNTPLENAE<br>EHITQVIGHSLPLRNEAFTGPESAGGEDETVIGWDMAIHAVAIPSTIPGNAYE<br>ELAIDEEAVAKEQSISTKPPYKERKDELK |
| SEQ ID NO: 82 | CSLTPEPGKPIQSKLSIPSDVVLDEGVLYYSMTINDEQNDIMDEGKGESIITIG<br>EFATVRATRHYVNQDAPFGVINLDITTENGTKTYSYNRKEGEFTINWLVPIG<br>EDSPASIKISVDELDQQRNIIEVPKLYSIDLDNQTLEQWENQGNVSFAVTRPE<br>QSIAKQSIAISWPSVSYKAAQKEGSRHKRWAHWHTGLALCWLVPIDAIYN<br>YITQQNCTLGDNWFGGSYETVAGTPKAITVKQGIEQKPVEQRIHFSKKNAM<br>EALAAHRVCGVPLETLARSRKPRDLTDDLSCAYQAQNIVSLFVATRILFSHL<br>DSVFTLNLDEQEPEVAERLSDLRRINENNPGMVTQVLTVARQIYNDYVTHH<br>PGLTPEQTSAGAQAADILSLFCPDADKSCVASNNDQANINIESRSGRSYLPE<br>NRAVITPQGVTNWTYQELEATHQALTREGYVFVGYHGTNHVAAQTIVNRI<br>APVPRGNNTENEEKWGGLYVATHAEVAHGYARIKEGTGEYGLPTRAERD<br>ARGVMLRVYIPRASLERFYRTNTPLENAEEHITQVIGHSLPLRNEAFTGPES<br>AGGEDETIIGWDMAIHAVAIPS |
| SEQ ID NO: 83 | CSLTPEPGKPIQSKLSIPSDVVLDEGVLYYSMTINDEQNDIMDEGKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFAVTR<br>PEQSIAKQSIAISWPSVSYKAAQKEGSRHKRWAHWHTGLALCWLVPMDAI<br>YNYITQQNCTLGDNWFGGSYETVAGTPKAITVKQGIEQKPVEQRIHFSKKN |

TABLE 2-continued

| Additional cholix polypeptides | |
|---|---|
| | AMEALAAHRVCGVPLETLARSRKPRDLTDDLSCAYQAQNIVSLFVATRILF<br>SHLDSVFTLNLDEQEPEVAERLSALRQINENNPGMVTQVLTVARQIYNDYV<br>THHPGLTPEQTSAGAQAADILSLFCPDADKSCVASNNDQANINIESRSGRSY<br>LPENRAVITPQGVTNWTYQELEATHQALTREGYVFVGYHGTNHVAAQTIV<br>NRIAPVPRGNNTENEEKWGGLYVATHAEVAHGYARIKEGTGEYGLPTRAE<br>RDARGVMLRVYIPRASLERFYRTNTPLENAEEHITQVIGHSLPLRNEAFTGP<br>ESAGGEDETVIGWDMAIHAVAIPS |
| SEQ ID NO: 84 | CSLTPEPGKPIQSKLSIPSDVVLDEGVLYYSMTINDEQNDIMDEGKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFAVTR<br>PEQSIAKQSIAISWPSVSYKAAQKEGSRHKRWAHWHTGLALCWLVPIDAIY<br>NYITQQNCTLGDNWFGGSYETVAGTPKAITVKQGIEQKPVEQRIHFSKKNA<br>MEALAAHRVCGVPLETLARSRKPRDLTDDLSCAYQAQNIVSLFVATRILFS<br>HLDSVFTLNLDEQEPEVAERLSALRQINENNPGMVTQVLTVARQIYNDYVT<br>HHPGLTPEQTSAGAQAADILSLFCPDADKSCVASNNDQANINIESRSGRSYL<br>PENRAVITPQGVTNWTYQELEATHQALTREGYVFVGYHGTNHVAAQTIVN<br>RIAPVPRGNNTENEEKWGGLYVATHAEVAHGYARIKEGTGEYGLPTRAER<br>DARGVMLRVYIPRASLERFYRTNTPLENAEEHITQVIGHSLPLRNEAFTGPE<br>SAGGEDETVIGWDMAIHAVAIPS |
| SEQ ID NO: 85 | MTINDEQNDIKDEDKGESIITIGEFATVRATRHYVNQDAPFGVINLDITTENG<br>TKTYSYNRKEGEFAINWLVPIGEDSPASIKISVDELDQQRNIIEVPKLYSIDLD<br>NQTLEQWENQGNVSFAVTRPEQSIAISWPSVSYKAAHKNGSRHKRWANW<br>LTTLPKVVLCFYEDPELCTYGDDWHGGAYKTVAGTPKAITVKQGIEQKAV<br>EQRIHFSKKNAMEALAAHRVCGVPLETLARSRKPRDLPDDLSCAYQAQNIV<br>SLFVATRILFSHLDSVFTLNLDEQEPEVAERLSALRQINENNPGMVTQVLTV<br>ARQIYNDYVTHHPGLTPEQTSAGAQAADILSLFCPDADKSCVASNNDQANI<br>NIESRSGRSYLPENRAVITPQGVTNWTYQELEATHQALTREGYVFVGYHGT<br>NHVAAQTIVNRIAPVPRGNNTENEEKWGGLYVATHAEVAHGYARIKEGTG<br>NGGLPTRAERETRGVMLRVYIPRASLERFYRTNTPLENAEEHITQVIGHSLP<br>LRNEAFTGPESAGGEDETVIGWDMAIYAVAIPSTIPGNAYEELAIDEEAVAK<br>EQSISAKPPYKEQKDELK |
| SEQ ID NO: 86 | MTINDEQNDIKDEDKGESIITIGDFATVRATRHYVNQDAPFGVINLDITTEN<br>GTKTYSYNRKEGEFAINWLVPIGEDSPASIKISVDEIDQQRNIIEVPKLYSIDL<br>DNQTLEQWENQGNVSFAVTRPEQSIAISWPSVSYKAAHKNGSRHKRWAN<br>WFTTSPKVTLCFYEDPAQCTYGDDWHGGAYKTVAGTPKAITVKQGIEQKT<br>VEQRIHFSKKNAMEALAAHRVCGVPLETLARSRKPRDLPDDLSCAYQAQNI<br>VSLFVATRILFSHLDSVFTLNLDEQEPEVAERLSALRQINENNPGMVTQVLT<br>VARQIYNDYVTHHPGLTPEQTSAGAQAADILSLFCPDADKSCVASNNDQA<br>NINIESRSGRSYLPENRAVITPQGVTNWTYQELEATHQALTREGYVFVGYH<br>GTNHVAAQTIVNRIAPVPRGNNTENEEKWGGLYVATHAEVAHGYARIKEG<br>TGEYGLPTRAERDARGVMLRVYIPRASLERFYRTNTPLENAEEHITQVIGHS<br>LPLRNEAFTGPERVDGEDETVIGWDMAIHAVAIPSTIPGNAYEELAIDEEAV<br>AKEQSISTKPPYKERKDELK |
| SEQ ID NO: 87 | CSLTPEPGKPIQSQLSIPSDVVLDEGVLYYSMTINDEQNDIKDEDKGESIITIG<br>EFATVRATRHYVNQDAPFGVIHLDITTENGTKTYSYNRKEGEFAINWLVPI<br>GEDSPASIKISVDELDQQRNIIEVPKLYSIDLDNQTLEQWENQGNVSFSVTRP<br>EHNIAISWPSVSYKAAQKEGSRHKRWAHWHTGLALCWLVPIDAIYNYITQ<br>QNCTLGDNWFGGSYETVAGTPKAITVKQGIEQKTVEQRIHFSKKNAMEAL<br>AAHRVCGVPLETLARSRKPRDLTDDLSCVYQAQNIVSLFVATRILFSHLDSV<br>FTLNLEEQEPEVAERLSALRQINENNPGMVTQVLTVARQIYNDYVTHHPGL<br>TPEQTSAGAQAADILSLFCPDADKSCVASNNDQANINIESRSGRSYLPENRA<br>VITPQGVTNWTYQELEATHQALTREGYVFVGYHGTNHVAAQTIVNRIAPV<br>PRGNNTENEEKWGGLYVATHAEVAHGYARIKEGTGEYGLPTRAERDARG<br>VMLRVYIPRASLERFYRTNTPLENAEEHITQVIGHSLPLRNEAFTGPERAGG<br>EDETVIGWDMAIHAVAIPS |
| SEQ ID NO: 88 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWKTQGNVSFSVTRP<br>EHNIAISWPSVSYKAAQKEGSRHKRWAHWHTGLALCWLVPMDAIYNYITQ<br>QNCTLGDNWFGGSYETVAGTPKVITVKQGIEQKPVEQRIHFSKGNAMSAL<br>AAHRVCGVPLETLARSRKPRDLTDDLSCAYQAQNIVSLFVATRILFSHLDSV<br>FTLNLDEQEPEVAERLSALRQINENNPGMVTQVLTVARQIYNDYVTHHPGL<br>TPEQTSAGAQAADILSLFCPDADKSCVASNNDQANINIESRSGRSYLPENRA<br>VITPQGVTNWTYQELEATHQALTREGYVFVGYHGTNHVAAQTIVNRIAPV<br>PRGNNTENEEKWGGLYVATHAEVAHGYARIKEGTGEYGLPTRAERDARG<br>VMLRVYIPRASLERFYRTNTPLENAEEHITQVIGHSLPLRNEAFTGPESAGG<br>EDETVIGWDMAIHAVAIPS |
| SEQ ID NO: 89 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWKTQGNVSFSVTRP<br>EHNIAISWPSVSYKAAQKEGSRHKRWAHWHTGLALCWLVPIDAIYNYITQ<br>QNCTLGDNWFGGSYETVAGTPKAITVKQGIEQKPVEQRIHFSKKNAMEAL |

TABLE 2-continued

| Additional cholix polypeptides | |
|---|---|
| | AAHRVCGVPLETLARSRKPRDLPDDLSCAYQAQNIVSLFVATRILFSHLDSV<br>FTLNLDEQEPEVAERLSALRQINENNPGMVTQVLTVARQIYNDYVTHHPGL<br>TPEQTSAGAQAADILSLFCPDADKSCVASNNDQANINIESRSGRSYLPENRA<br>VITPQGVTNWTYQELEATHQALTREGYVFVGYHGTNHVAAQTIVNRIAPV<br>PRGNNTENEEKWGGLYVATHAEVAHGYARIKEGTGEYGLPTRAERDARG<br>VMLRVYIPRASLERFYRTNTPLENAEEHITQVIGHSLPLRNEAFTGPESAGG<br>EDETVIGWDMAIHAVAIPS |
| SEQ ID NO: 90 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWKTQGNVSFSVTRP<br>EHNIAISWPSVSYKAAQKEGSRHKRWAHWHTGLALCWLVPIDAIYNYITQ<br>QNCTLGDNWFGGSYETVAGTPKAITVKQGIEQKPVEQRIHFSKKNAMEAL<br>AAHRVCGVPLETLARSRKPRDLPDDLSCAYQAQNIVSLFVATRILFSHLDSV<br>FTLNLDEQEPEVAERLSALRQINENNPGMVTQVLTVARQIYNDYVTHHPGL<br>IPEQTSAGAQAADILSLFCPDADKPCVASNNDQANINIESRSGRSYLPENRA<br>VITPQGVTNWTYQELEATHQALTREGYVFVGYHGTNHVAAQTIVNRIAPV<br>PRGNNTENEEKWGGLYVATHAEVAHGYARIKEGTGEYGLPTRAEREARG<br>VMLRVYIPRASLERFYRTNTPLENAERHITQVIGHSLPLRNEAFTGPESAGG<br>EDETVIGWDMAIHAVAIPS |
| SEQ ID NO: 91 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFSVTRP<br>EHNIAISWPSVSYKAAQKEGSRHKRWAHWHTGLALCWLVPIDAIYNYITQ<br>QNCTLGDNWFGGSYETVAGTPKAITVKQGIEQKTVEQRIHFSKKNAMEAL<br>AAHRVCGVPLETLARSRKPRDLTDDLSCVYQAQNIVSLFVATRILFSHLDSV<br>FTLNLEEQEPEVAERLSALRQINENNPGMVTQVLTVARQIYNDYVTHHPGL<br>TPEQTSAGAQAADILSLFCPDADKSCVASNNDQANINIESRSGRSYLPENRA<br>VITPQGVTNWTYQELEATHQALTREGYVFVGYHGTNHVAAQTIVNRIAPV<br>PRGNNTENEEKWGGLYVATHAEVAHGYARIKEGTGNGGLPTRAERETRG<br>VMLRVYIPRASLERFYRTNTPLENAEEHITDVIGHSLPLRNEAFTGPESAGG<br>EDETVIGWDMAIHAVAIPS |
| SEQ ID NO: 92 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFSVTRP<br>EHNIAISWPSVSYKAAQKEGSRHKRWAHWHTGLALCWLVPIDAIYNYITQ<br>QNCTLGDNWFGGSYETVAGTPKAITVKQGIEQKPVEQRIHFSKKNAMEAL<br>AAHRVCGVPLETLARSRKPRDLPDDLSCAYQAQNIVSLFVATRILFSHLDSV<br>FTLNLDEQEPAVAERLSALRQINENNPGMVTQVLTVARQIYNDYVTHHPGL<br>TPEQTSAGAQAADILSLFCPDADKSCVALNNDQANINIESRSGRSYLPENRA<br>VITPQGVTNWTYQELEATHQALTREGYVFVGYHGTNHVAAQTIVNRIAPV<br>PRGNNTENEEKWGGLYVATHAEVAHGYARIKEGTGEYGLPTRAERDARG<br>VMLRVYIPRASLERFYRTNTPLENAEEHITQVIGHSLPLRNEAFTGPESAGG<br>EDETVIGWDMAIHAVAIPS |
| SEQ ID NO: 93 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFSVTRP<br>EHNIAISWPSVSYKAAQKEGSRHKRWAHWHTGLALCWLVPIDAIYNYITQ<br>QNCTLGDNWFGGSYETVAGTPKAIMVKQGIEQKPVEQRIHFSKKNAMEAL<br>AAHRVCGVPLETLARSRKPRYLPDDLSCAYQAQNIVSLFVATRILFSHLDSV<br>FTLNLDEQEPEVAERLSALRQINENNPGMVTQVLTVARQIYNDYVTHHPGL<br>TPEQTSAGAQAADILSLFCPDADKSCVASNNDQANINIESRSGRSYLPENRA<br>VITPQGVTNWTYQELEATHQALTREGYVFVGYHGTNHVAAQTIVNRIAPV<br>PRGNNTENEEKWGGLYVATHAEVAHGYARIKEGTGEYGLPTRAERDARG<br>VMLRVYIPRASLERFYRTNTPLENAEEHITQVIGHSLPLRNEAFTGPERVDG<br>EDETVIGWDMAIHAVAIPS |
| SEQ ID NO: 94 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKDGEFAINWLVPI<br>GEDSPASIKISVDELDQQRNIIEVPKLYSIDLDNQTLEQWKTQGNVSFSVTRP<br>EHNIAISWPSVSYKAAQKEGSRHKRWAHWHTGLALCWLVPIDAIYNYITQ<br>QNCTLGDNWFGGSYETVAGTPKAITVKQGIEQKPVEQRIHFSKKNAMEAL<br>AAHRVCGVPLETLARSRKPRDLPDDLSCAYQAQNIVSLFVATRILFSHLDSV<br>FTLNLDEQEPAVAERLSAIRQINENNPGMVTQVLTVARQIYNDYVTHHPGL<br>TPEQTSAGAQAADILSLFCPDADKSCVASDNDQANINIESRSGRSYLPENRA<br>VITPQGVTNWTYQELEATHQALTREGYVFVGYHGTNHVAAQTIVNRIAPV<br>PRGNNTENEEKWGGLYVATHAEVAHGYARIKEGTGEYGLPTRAERDARG<br>VMLRVYIPRASLERFYRTNTPLENAEEHITQVIGHSLPLRNEAFTGPESAGG<br>EDETVIGWDMAIHAVAIPS |
| SEQ ID NO: 95 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKDGEFAINWLVPI<br>GEDSPASIKISVDELDQQRNIIEVPKLYSIDLDNQTLEQWKTQGNVSFSVTRP<br>EHNIAISWPSVSYKAAQKEGSRHKRWAHWHTGLALCWLVPIDAIYNYITQ<br>QNCTLGDNWFGGSYETVAGTPKAITVKQGIEQKPVEQRIHFSKKNAMEAL |

TABLE 2-continued

| Additional cholix polypeptides | |
|---|---|
| | AAHRVCGVPLETLARSRKPRDLPDDLSCAYQAQNIVSLFVATRILFSHLDSV FTLNLDEQEPAVAERLSALRQINENNPGMVTQVLTVARQIYNDYVTHHPGL TPEQTSAGAQAADILSLFCPDADKSCVASDNDQANINIESRSGRSYLPENRA VITPQGVTNWTYQELEATHQALTREGYVFVGYHGTNHVAAQTIVNRIAPV PRGNNTENEEKWGGLYVATHAEVAHGYARIKEGTGEYGLPTRAERDARG VMLRVYIPRASLERFYLTNTPLENAEEHITQVIGHSLPLRNEAFTGPESAGGE DETVIGWDMAIHAVAIPS |
| SEQ ID NO: 96 | CSLTPEPGKPIQSKLSIPSDVVLDEGVLYYSMTINDEQNDIKDEDKGESIITIG EFATVRATRHYVNQDAPFGVIHLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPMDAIYNYITQ QNCTLGDNWFGGSYETVAGTPKVITVKQGIEQKPVEQRIHFSKGNAMSAL AAHRVCGVPLETLARSRKPRDLTDDLSCAYQAQNIVSLFVATRILFSHLDSV FTLNLDEQEPEVAERLSDLRRINENNPGMVTQVLTVARQIYNDYVTHHPGL TPEQTSAGAQAADILSLFCPDADKSCVASNNDQANINIESRSGRSYLPENRA VITPQGVTNWTYQELEATHQALTREGYVFVGYHGTNHVAAQTIVNRIAPV PRGNNTENEEKWGGLYVATHAEVAHGYARIKEGTGEYGLPTRAERDARG VMLRVYIPRASLERFYRTNTPLENAEEHITQVIGHSLPLRNEAFTGPESAGG EDETVIGWDMAIHAVAIPS |
| SEQ ID NO: 97 | CSLTPEPGKPIQSKLSIPSDVVLDEGVLYYSMTINDEQNDIKDEDKGESIITIG EFATVRATRHYVNQDAPFGVIHLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPMDAIYNYITQ QNCTLGDNWFGGSYETVAGTPKVITVKQGIEQKPVEQRIHFSKGNAMSAL AAHRVCGVPLETLARSRKPRDLTDDLSCAYQAQNIVSLFVATRILFSHLDSV FTLNLDEQEPEVAERLSDLRRINENNPGMVTQVLTVARQIYNDYVTHHPGL TPEQTSAGAQAADILSLFCPDADKSCVASNNDQANINIESRSGRSYLPENRA VITPQGVTNWTYQELEATHQALTREGYVFVGYHGTNHVAAQTIVNRIAPV PRGNNTENEEKWGGLYVATHAEVAHGYTRIKEGTGEYGLPTRAERDARG VMLRVYIPRASLERFYRTNTPLENAEEHITQVIGHSLPLRNEAFTGPESAGG EDETVIGWDMAIHAVAIPS |
| SEQ ID NO: 98 | CSLTPEPGKPIQSKLSIPSDVVLDEGVLYYSMTINDEQNDIKDEDKGESIITIG EFATVRATRHYVNQDAPFGVIHLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPMDAIYNYITQ QNCTLGDNWFGGSYETVAGTPKVITVKQGIEQKPVEQRIHFSKGNAMSAL AAHRVCGVPLETLARSRKPRDLTDDLSCAYQAQNIVSLFVATRILFSHLDSV FTLNLDEQEPEVAERLSDLRRINENNPGMVTQVLTVARQIYNDYVTHHPGL TPEQTSAGAQAADILSLFYPDADKSCVASNNDQANINIESRSGRSYLPENRA VITPQGVTNWTYQELEATHQALTREGYVFVGYHGTNHVAAQTIVNRIAPV PRGNNTENEEKWGGLYVATHAEVAHGYARIKEGTGEYGLPTRAERDARG VMLRVYIPRASLERFYRTNTPLENAEEHITQVIGHSLPLRNEAFTGPESAGG EDETVIGWDMAIHAVAIPS |
| SEQ ID NO: 99 | CSLTPEPGKPIQSKLSIPSDVVLDEGVLYYSMTINDEQNDIKDEDKGESIITIG EFATVRATRHYVNQDAPFGVIHLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPMDAIYNYITQ QNCTLGDNWFGGSYETVAGTPKVITVKQGIEQKPVEQRIHFSKGNAMSAL AAHRVCGVPLETLARSRKPRDLTDDLSCAYQAQNIVSLFVATRILFSHLDSV FTLNLDEQEPEVAERLSDLRRINENNPGMVTQVLTVARQIYNDYVTHHPGL TPEQTSAGAQAADILSLFCPDADKSCVASNNDQANINIESRSGRSYLPENRA VITPQGVTNWTYQELEATHQALTREGYVFVGYHGTNHVAAQTIVNRIAPV PRGNNTENEEKWGGLYVATHAEVAHGYARIKEGTGNGGLPTRAERETRG VMLRVYIPRASLERFYRTNTPLENAEEHITQVIGHSLPLRNEAFTGPESAGG EDETVIGWDMAIHAVAIPS |
| SEQ ID NO: 100 | CSLTPEPGKPIQSKLSIPSDVVLDEGVLYYSMTINDEQNDIKDEDKGESIITIG EFATVRATRHYVNQDAPFGVIHLDITTENGTKTYSYNRKEGEFAINWLVPI GEDSPASIKISVDELDQQRNIIEVPKLYSIDLDNQTLEQWENQGNVSFSVTRP EHNIAISWPSVSYKAAQKEGSRHKRWAHWHTGLALCWLVPMDAIYNYITQ KNCTLGDNWFGGSYETVAGTPKVITVKQGIEQKPVEQRIHFSKGNAMSAL AAHRVCGVPLETLARSRKPRDLTDDLSCAYQAQNIVSLFVATRILFSHLDSV FTLNLDEQEPEVAERLSDLRRINENNPGMVTQVLTVARQIYNDYVTHHPGL TPEQTSAGAQAADILSLFCPDADKSCVASNNDQANINIESRSGRSYLPENRA VITPQGVTNWTYQELEATHQALTREGYVFVGYHGTNHVAAQTIVNRIAPV PRGNNTENEEKWGGLYVATHAEVAHGYARIKEGTGEYGLPTRAERDARG VMLRVYIPRASLERFYRTNTPLENAEEHITQVIGHSLPLRNEAFTGPESAGG EDETVIGWDMAIHAVAIPS |
| SEQ ID NO: 101 | CSLTPEPGKPIQSKLSIPSDVVLDEGVLYYSMTINDEQNDIKDEDKGESIITIG EFATVRATRHYVNQDAPFGVIHLDITTENGTKTYSYNRKEGEFAINWLVPI GEDSPASIKISVDELDQQRNIIEVPKLYSIDLDNQTLEQWENQGNVSFSVTRP EHNIAISWPSVSYKAAQKEGSRHKRWAHWHTGLALCWLVPIDAIYNYITQ QNCTLGDNWFGGSYETVAGTPKAITVKQGIEQKPVEQRIHFSKKNAMEAL |

TABLE 2-continued

| Additional cholix polypeptides | |
|---|---|
| | AAHRVCGVPLETLARSRKPRDLPDDLSCAYQAQNIVSLFVATRILFSHLDSV FTLNLDEQEPEVAERLSALRQINENNPGMVTQVLTVARQIYNDYVTHHPGL TPEQTSAGAQAADILSLFCPDADKSCVASNNDQANINIESRSGRSYLPENRA VITPQGVTNWTYQELEATHQALTREGYVFVGYHGTNHVAAQTIVNRIAPV PRGNNTENEEKWGGLYVATHAEVAHGYARIKEGTGEYGLPTRAERDARG VMLRVYIPRASLERFYRTNTPLENAEEHITQVIGHSLPLRNEAFTGPESAGG EDETVIGWDMAIHAVAIPS |
| SEQ ID NO: 102 | CSLTPELGKPIQSKLSISSDVVLDEGVLYYSMTINDEQNDIKDEDKGESIITIG EFATVRATRHYVNQDAPFGVINLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPIDAIYNYITQ QNCTLGDNWFGGSYETVAGTPKAITVKQGIEQKPVEQRIHFSKKNAMEAL AAHRVCGVPLETLARSRKPRDLPDDLSCAYQAQNIVSLFVATRILFSHLDSV FTLNLDEQEPEVAERLSALRQINENNPGMVTQVLTVARQIYNDYVTHHPGL TPEQTSAGAQAADILSLFCPDADKPCVASNNDQANINVESRSGRSYLPENR AVITPQGVTNWTYQELEATHQALTREGYVFVGYHGTNHVAAQTIVNRIAP VPRGNNTENEEKWGGLYVATHAEVAHGYARIKEGTGEYGLPTRAERDAR GVMLRVYIPRASLERFYRTNTPLENAERHITQVIGHSLPLRNEAFTGPESAG GEDETVIGWDMAIHAVAIPS |
| SEQ ID NO: 103 | CSLTPELGKPIQSKLSIPSDVVLDEGVLYYSMTINDEQNDIKDEDKGESIITIG EFATVRATRHYVNQDAPFGVINLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPIDAIYNYITQ QNCTLGDNWFGGSYETVAGTPKAITVKQGIEQKPVEQRIHFSKKNAMEAL AAHRVCGVPLETLARSRKPRDLPDDLSCAYQAQNIVSLFVATRILFSHLDSV FTLNLDEQEPEVAERLSALRQINENNPGMVTQVLTVARQIYNDYVTHHPGL TPEQTSAGAQAADILSLFCPDADKSCVASNNDQANINIESRSGRSYLPENRA VITPQGVTNWTYQELEATHQALTREGYVFVGYHGTNHVAAQTIVNRIAPV PRGNNTENEEKWGGLYVATHAEVAHGYARIKEGTGEYGLPTRAERDARG VMLRVYIPRASLERFYRTNTPLENAEEHITQVIGHSLPLRNEAFTGPESAGG EDETVIGWDMAIHAVAIPS |
| SEQ ID NO: 104 | CSLTPELGKPIQSKLSIPSDVVLDEGVLYYSMTINDEQNDIKDEDKGESIITIG EFATVRATRHYVNQDAPFGVINLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPIDAIYNYITQ QNCTLGDNWFGGSYETVAGTPKAITVKQGIEQKPVEQRIHFSKKNAMEAL AAHRVCGVPLETLARSRKPRDLPDDLSCAYQAQNIVSLFVATRILFSHLDSV FTLNLEEQEPEVAERLSALRQINENNPGMVTQVLTVARQIYNDYVTHHPGL TPEQTSAGAQAADILSLFCPDADKSCVASNNDQANINIESRSGRSYLPENRA VITPQGVTNWTYQELEATHQALTREGYVFVGYHGTNHVAAQTIVNRIAPV PRGNNTENEEKWGGLYVATHAEVAHGYARIKEGTGEYGLPTRAERDARG VMLRVYIPRASLERFYRTNTPLENAEEHITQVIGHSLPLRNEAFTGPESAGG EDETVIGWDMAIHAVAIPS |
| SEQ ID NO: 105 | CSLTPELGKPIQSKLSIPSDVVLDEGVLYYSMTINDEQNDIKDEDKGESIITIG EFATVRATRHYVNQDAPFGVINLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPIDAIYNYITQ QNCTLGDNWFGGSYETVAGTPKAITVKQGIEQKPVEQRIHFSKKNAMEAL AAHRVCGVPLETLARSRKPRDLPDDLSCAYQAQNIVSLFVATRILFSHLDSV FTLNLDEQEPAVAERLSALRQINENNPGMVTQVLTVARQIYNDYVTHHPGL TPEQTSAGAQAADILSLFCPDADKSCVASDNDQANINIESRSGRSYLPENRA VITPQGVTNWTYQELEATHQALTREGYVFVGYHGTNHVAAQTIVNRIAPV PRGNNTENEEKWGGLYVATHAEVAHGYARIKEGTGEYGLPTRAERDARG VMLRVYIPRASLERFYRTNTPLENAEEHITQVIGHSLPLRNEAFTGPESAGG EDETVIGWDMAIHAVAIPS |
| SEQ ID NO: 106 | CSLTPELGKPIQSKLSIPSDVVLDEGVLYYSMTINDEQNDIKDEDKGESIITIG EFATVRATRHYVNQDAPFGVINLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPIDAIYNYITQ QNCTLGDNWFGGSYETVAGTPKAITVKQGIEQKPVEQRIHFSKKNAMEAL AAHRVCGVPLETLARSRKPRDLPDDLSCAYQAQNIVSLFVATRILFSHLDSV FTLNLDEQEPEVAERLSALRQINENNPGMVTQVLTVARQIYNDYVTHHPGL TPEQTSAGAQAADILSLFCPDADKPCVASNNDQANINVESRSGRSYLPENR AVITPQGVTNWTYQELEATHQALTREGYVFVGYHGTNHVAAQTIVNRIAP VPRGNNTENEEKWGGLYVATHAEVAHGYARIKEGTGEYGLPTRAEREAR GVMLRVYIPRASLERFYRTNTPLENAERHITQVIGHSLPLRNEAFTGPESAG GEDETVIGWDMAIHAVAIPS |
| SEQ ID NO: 107 | CSLTPELGKPIQSKLSIPSDVVLDEGVLYYSMTINDEQNDIKDEDKGESIITIG EFATVRATRHYVNQDAPFGVINLDITTENGTKTYSYNRKEGEFAINWLVPI GEDSPASIKISVDELDQQRNIIEVPKLYSIDLDNQTLEQWKTQGNVSFSVTRP EHNIAISWPSVSYKAAQKEGSRHKRWAHWHTGLALCWLVPIDAIYNYITQ QNCTLGDNWFGGSYETVAGTPKAITVKQGIEQKPVEQRIHFSKKNAMEAL |

TABLE 2-continued

| Additional cholix polypeptides | |
|---|---|
| | AAHRVCGVPLETLARSRKPRDLPDDLSCAYQAQNIVSLFVATRILFSHLDSV<br>FTLNLDEQEPAVAERLSALRQINENNPGMVTQVLTVARQIYNDYVTHHPGL<br>TPEQTSAGAQAADILSLFCPDADKSCVASNNDQANINIESRSGRSYLPENRA<br>VITPQGVTNWTYQELEATHQALTREGYVFVGYHGTNHVAAQTIVNRIAPV<br>PRGNNTENEEKWGGLYVATHAEVAHGYARIKEGTGEYGLPTRAERDARG<br>VMLRVYIPRASLERFYRTNTPLENAEEHITQVIGHSLPLRNEAFTGPERVDG<br>EDETVIGWDMAIHAVAIPS |
| SEQ ID NO: 108 | CSLTPELGKPIQSKLSIPSDVVLDEGVLYYSMTINDDQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWKTQGNVSFSVTRP<br>EHNIAISWPSVSYKAAQKEGSRHKRWAHWHTGLALCWLVPIDAIYNYITQ<br>QNCTLGDNWFGGSYETVAGTPKAITVKQGIEQKPVEQRIHFSKKNAMEAL<br>AAHRVCGVPLETLARSRKPRDLPDDLSCAYQAQNIVSLFVATRILFSHLDSV<br>FTLNLDEQEPEVAERLSALRQINENNPGMVTQVLTVARQIYNDYVTHHPGL<br>TPEQTSAGAQAADILSLFCPDADKPCVASNNDQANINIESRSGRSYLPENRA<br>VITPQGVTNWTYQELEATHQALTREGYVFVGYHGTNHVAAQNIVNRIAPV<br>PRGNNTENEEKWGGLYVATHAEVAHGYARIKEGTGEYGLPTRAERDARG<br>VMLRVYIPRASLERFYRTNTPLENAEEHITQVIGHSLPLRNEAFTGPESAGG<br>EDETVIGWDMAIHAVAIPS |
| SEQ ID NO: 109 | CSLTPEPGKPIQSKLSIPSDVVLDEGVLYYSMTINDEQNDIMDEGKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFAVTR<br>PEQSIAKQSIAISWPSVSYKAAHKNGSRHKRWANWLTTLPKVVLCFFEDPE<br>LCTYGEDWHGGAYKTVAGTPKAITVKQGIEQKTVEQRIHFSKKNAMEALA<br>AHRVCGVPLETLARSRKPRDLPDDLSCAYQAQNIVSLFVATRILFSHLDSVF<br>TLNLDEQEPEVAERLSALRQINENNPGMVTQVLTVARQIYNDYVTHHPGLT<br>PEQTSAGAQAADILSLFCPDADKSCVASNNDQANINIESRSGRSYLPENRAV<br>ITPQGVTNWTYQELEATHQALTREGYVFVGYHGTNHVAAQTIVNRIAPVP<br>RGNNTENEEKWGGLYVATHAEVAHGYARIKEGTGEYGLPTRAERDARGV<br>MLRVYIPRASLERFYRTNTLLENAEEHITQVIGHSLPLRNEAFTGPESAGGE<br>DETVIGWDMAIHAVAIPS |
| SEQ ID NO: 110 | CSLTPEPGKPIQSKLSIPSDVVLDEGVLYYSMTINDEQNDIKDEDKGESIITIG<br>EFATVRATRHYVSQDAPFGVINLDITTENGTKTYSFNRKESEFAINWLVPIG<br>EDSPASIKISVDELDQQRNIIEVPKLYSIDLDNQTLEQWETQGNVSFAVTRPE<br>QSIAISWPSVSYKAAHKNGSRHKRWANWFTTSPKVTLCFYEDPAQCTYGD<br>DWHGGAYKTVAGTPKAITVKQGIEQKTVEQRIHFSKKNAMEALAAHRVC<br>GVPLETLARSRKPRDLPDDLSCAYQAQNIVSLFVATRILFSHLDSVFTLNLD<br>EQEPEVAERLSALRQINENNPGMVTQVLTVARQIYNDYVTHHPGLTPEQTS<br>AGAQAADILSLFCPDADKSCVASNNDQANINIESRSGRSYLPENRAVITPQG<br>VTNWTYQELEATHQALTREDYVFVGYHGTNHVAAQTIVNRIAPVPRGNNT<br>ENEEKWGGLYVATHAEVAHGYARIKEGTGEYGLPTRAERDARGVMLRVY<br>IPRASLERFYRTNTPLENAEEHITQVIGHSLPLRNEAFTGPESAGGEDETVIG<br>WDMAIHAVAIPS |
| SEQ ID NO: 111 | CSLTPEPGKPIQSKLSIPSDVVLDEGVLYYSMTINDEQNDIKDEDKGESIITIG<br>EFATVRATRHYVSQDAPFGVINLDITTENGTKTYSFNRKESEFAINWLVPIG<br>EDSPASIKISVDELDQQRNIIEVPKLYSIDLDNQTLEQWETQGNVSFAVTRPE<br>QSIAISWPSVSYKAAHKNGSRHKRWANWFTTSPKVTLCFYEDPAQCTYGD<br>DWHGGAYKTVAGTPKAITVKQGIEQKTVEQRIHFSKKNAMEALAAHRVC<br>GVPLETLARSRKPRDLPDDLSCAYQAQNIVSLFVATRILFSHLDSVFTLNLD<br>EQEPEVAERLSALRQINENNPGMVTQVLTVARQIYNDYVTHHPGLTPEQTS<br>AGAQAADILSLFCPDADKSCVASNNDQANINIESRSGRSYLPENRAVITPQG<br>VTNWTYQELEATHQALTREDYVFVGYHGTNHAAAQTIVNRIAPVPRGNNT<br>ENEEKWGGLYVATHAEVAHGYARIKEGTGEYGLPTRAEQETRGVMLRVYI<br>PRASLERFYRTNTPLENAEEHITQVIGHSLPLRNEAFTGPESAGGEDETVIG<br>WDMAIHAVAIPS |
| SEQ ID NO: 112 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFAVTR<br>PEQSIAISWPSVSYKAAHKNGSRHKRWANWLTTLPKVVLCFYEDPELCTY<br>GDDWHGGAYKTVAGTPKAITVKQGIEQKTVEQRIHFSKKNAMEALAAHR<br>VCGVPLETLARSRKPRDLTDDLSCAYQAQNIVSLFVATRILFSHLDSVFTLN<br>LDEQEPEVAERLSALRQINENNPGMVTQVLTVARQIYNDYVTHHPGLTPEQ<br>TSAGAQAADILSLFCPDADKSCVASNNDQANINIESRSGRSYLPENRAVITP<br>QGVTNWTYQELEATHQALTREGYVFVGYHGTNHVAAQTIVNRIAPVPRGN<br>NTENEEKWGGLYVATHAEVAHGYARIKEGTGEYGLPTRAERDARGVMLR<br>VYIPRASLERFYRTNTPLENAEEHITQVIGHSLPLRNEAFTGPESAGGEDETV<br>IGWDMAIHAVAIPS |
| SEQ ID NO: 113 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFAVTR<br>PEQSIAISWPSVSYKAAHKNGSRHKRWANWLTTLPKVVLCFYEDPELCTY<br>GDDWHGGAYKTVAGTPKAITVKQGIEQKTVEQRIHFSKKNAMEALAAHR |

TABLE 2-continued

| Additional cholix polypeptides | |
|---|---|
| | VCGVPLETLARSRKPRDLPDDLSCAYQAQNIVSLFVATRILFSHLDSVFTLN<br>LDEQAPEVAERLSDLRRINEDNPGMVTQVLTVARQIYNDYVTHHPGLTPEQ<br>TSAGAQAADILSLFCPDADKSCVASNNDQANINIESRSGRSYLPENRAVITP<br>QGVTNWTYQELETTHQALTREGYVFVGYHGTNHVAAQTIVNRIAPVPRGN<br>NTENEEKWGGLYVATHAEVAHGYARIKEGTGEYGLPTRAERETRGVMLR<br>VYIPRASLERFYRTNTPLENAEEHITQVIGHSLPLRNEAFTGPESAGGEDETV<br>IGWDMAIHAVAIPS |
| SEQ ID NO: 114 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFAVTR<br>PEQSIAISWPSVSYKAAHKNGSRHKRWANWLTTLPKVVLCFYEDPELCTY<br>GDDWHGGAYKTVAGTPKAITVKQGIEQKTVEQRIHFSKKNAMEALAAHR<br>VCGVPLETLARSRKPRDLPDDLSCAYQAQNIVSLFVATRILFSHLDSVFTLN<br>LDEQEPEVAERLSALRQINENNPGMVTQVLTVARQIYNDYVTHHPGLTPEQ<br>TSAGAQAADILSLFCPDADKSCVASNNDQANINIESRSGRSYLPENRAVITP<br>QGVTNWTYQELEATHQALTREGYVFVGYHGTNHVAAQTIVNRIAPVPRGN<br>NTENEEKWGGLYVATHAEVAHGYARIKEGTGNGGLPTRAERETRGVMLR<br>VYIPRASLERFYRTNTPLENAEEHITQVIGHSLPLRNEAFTGPESAGGEDETV<br>IGWDMAIYAVAIPS |
| SEQ ID NO: 115 | CSLTPEPGKPIQSKLSIPSDVVLDEGVLYYSMTINDEQNDIKDEDKGESIITIG<br>EFATVRATRHYVNQDAPFGVINLDITTENGTKTYSYNRKEGEFAINWLVPI<br>GEDSPASIKISVDEIDQQRNIIEVPKLYSIDLDNQTLEQWENQGNVSFAVTRP<br>EQSIAISWPSVSYKAAHKNGSRHKRWANWFTTSPKVTLCFYEDPAQCTYG<br>DDWHGGAYKTVAGIPKAITVKQGIEQKTVEQRIHFSKKNAMEALAAHRVC<br>GVPLETLARSRKPRDLPDDLSCAYQAQNIVSLFVATRILFSHLDSVFTLNLD<br>EQEPEVAERLSALRQINENNPGMVTQVLTVARQIYNDYVTHHPGLTPEQTS<br>AGAQAADILSLFCPDADKSCVASNNDQANINIESRSGRSYLPENRAVITPQG<br>VTNWTYQELEATHQALTREDYVFVGYHGTNHVAAQTIVNRIAPVPRGNNT<br>ENEEKWGGLYVATHAEVAHGYARIKEGTGEYGLPTRAEQETRGVMLRVYI<br>PRASLERFYRTNTPLENAEEHITQVIGHSLPLRNEAFTGPESAGGEDETVIG<br>WDMAIHAVAIPS |
| SEQ ID NO: 116 | CSLTPEPGKPIQSKLSIPSDVVLDEGVLYYSMTINDEQNDIKDEDKGESIITIG<br>EFATVRATRHYVNQDAPFGVIHLDITTENGTKTYSYNRKEGEFAINWLVPI<br>GEDSPASIKISVDELDQQRNIIEVPKLYSIDLDNQTLEQWENQGNVSFAVTR<br>PEQSIAISWPSVSYKAAHKNGSRHKRWANWLTTLPKVVLCFYEEPELCTYG<br>EDWHGGAYKTVAGTPGAITVKQGIEQKTVEQRIHFSKGNAMSALAAHRVC<br>GVPLETLARSRKPRDLTDDLSCAYQAQNIVSLFVATRILFSHLDSVFTLNLD<br>EQEPEVAERLSALRQINENNPGMVTQVLTVARQIYNDYVTHHPGLTPEQTS<br>AGAQAADILSLFCPDADKSCVASNNDQANINIESRSGRSYLPENRAVITPQG<br>VTNWTYQELEATHQALTREGYVFVGYHGTNHVAAQTIVNRIAPVPRGNNT<br>ENEEKWGGLYVATHAEVAHGYARIKEGTGEYGLPTRAERDARGVMLRVY<br>IPRASLERFYRTNTPLENAEEHITQVIGHSLPLRNEAFTGPESAGGEDETVIG<br>WDMAIHAVAIPS |
| SEQ ID NO: 117 | CSLTPEPGKPIQSKLSIPSDVVLDEGVLYYSMTINDEQNDIKDEDKGESIITIG<br>EFATVRATRHYVNQDAPFGVIHLDITTENGTKTYSYNRKEGEFAINWLVPI<br>GEDSPASIKISVDELDQKRNIIEVPKLYSIDLDNQTLEQWENQGNVSFAVTR<br>PEQSIAISWPSVSYKAAHKNGSRHKRWANWLTTLPKVVLCFYEEPELCTYG<br>EDWHGGAYKTVAGTPEAITVKQGIEQKTVEQRIHFSKKNAMEALAAHRVC<br>GVPLETLARSRKPRDLPDDLSCAYQAQNIVSLFVATRILFSHLDSVFTLNLD<br>EQEPAVAERLSALRQINENNPGMVTQVLTVARQIYNDYVTHHPGLTPEQTS<br>AGAQAADILSLFCPDADKSCVASNNDQANINIESRSGRSYLPENRAVITPQG<br>VTNWTYQELEATHQALTREGYVFVGYHGTNHVAAQTIVNRIAPVPRGNNT<br>ENEEKWGGLYVATHAEVAHGYARIKEGTGEYGLPTRAERDARGVMLRVY<br>IPRASLERFYRTNTPLENAEEHITQVIGHSLPLRNEAFTGPESAGGEDETVIG<br>WDMAIHAVAIPS |
| SEQ ID NO: 118 | CSLTPEPGKPIQSKLSIPSDVVLDEGVLYYSMTINDEQNDIKDEDKGESIIIIG<br>EFATVRATRHYVNQDAPFGVINLDITTENGTKTYSYNRKEGEFAINWLVPI<br>GEDSPASIKISVDELDQQRNIIEVPKLYSIDLDNQTLEQWENQGNVSFAVTR<br>PEQSIAISWPSVSYKAAHKNGSRHKRWANWLTTLPKVVLCFYEDPELCTY<br>GDDWHGGAYKTVAGTPKAITVKQGIEQKTVEQRIHFSKGNAMSALAAHR<br>VCGVPLETLARSRKPRDLTDDLSCAYQAQNIVSLFVATRILFSHLDSVFTLN<br>LDEQEPEVAERLSDLRRINENNPGMVTQVLTVARQIYNDYVTHHPGLTPEQ<br>TSAGAQAADILSLFCPDADKSCVASNNDQANINIESRSGRSYLPENRVVITP<br>QGVTNWTYQELDATHQALTREDYVFVGYHGTNHVAAQTIVNRIAPVPRG<br>NNTENEEKWGGLYVATHAEVAHGYARIKEGTGEYGLPTRAERETRGVML<br>RVYIPRASLERFYRTNTPLENAEEHITQVIGHSLPLRNEAFTGPESAGGEDET<br>VIGWDMAIHAVAIPS |
| SEQ ID NO: 119 | CSLTPEPGKPIQSKLSIPGDVVLDEGVLYYSMTINDEQNDIKDEDKGESIITIG<br>EFATVRATRHYVSQDAPFGVINLDITTENGTKTYSFNRKESEFAINWLVPIG<br>EDSPASIKISIDELDQQRNIIEVPKLYSIDLDNQTLEQWENQGNVSFAVTRPE<br>QSIAISWPSVSYKAAHKNGSRHKRWANWLTTLPEVVLCFFEDPELCTYGD<br>DWHGGAYKTVAGTPKAITVKQGIEQKTVEQRIHFSKKNAMEALAAHRVC |

TABLE 2-continued

| Additional cholix polypeptides | |
|---|---|
| | GVPLETLARSRKPRDLPDDLSCAYNAQQIVSLFLATRILFTHIDSIFTLNLDG QEPEVAERLDDLRRINENNPGMVIQVLTVARQIYNDYVTHHPGLTPEQTSA GAQAADILSLFCPDADKSCVASNSDQANINIESRSGRSYLPENRAVITQQGV TNWTYQELEATHQALTQEGYVFVGYHGTNHVAAQSIVNRISPVPRGSDTES ERAWGGLYVSTDASVAYGYARIQEGTADGGGLTPAERKARGVMLRVYLP QASLERFYRINADLEKERNLVERVIGHPLPLRNEAFTGTDAEEGSDETAIGW DMAIHGVAIPS |
| SEQ ID NO: 120 | CSLTPEPGKPIQSKLSIPGDVVLDEGVLYYSMTINDEQNDIKDEDKGESIITIG EFATVRATRHYVSQDAPFGVINLDITTENGTKTYSFNRKESEFAINWLVPIG EDSPASIKISIDELDQQRNIIEVPKLYSIDLDNQTLEQWENQGNVSFAVTRPE QSIAISWPSVSYKAAHKNGSRHKRWANWLTTLPEVVLCFFEDPELCTYGD DWHGGAYKTVAGTPKAITVKQGIEQKTVEQRIHFSKKNAMEALAAHRVC GVPLETLARSRKPRDLPDDLSCAYNAQQIVSLFLATRILFTHIDSIFTLNLDG QEPEVAERLDDLRRINENNPGMVIQVLTVARQIYNDYVTHHPGLTPEQTSA SAQAADILSLFCPDADKSCVASNSDQANINIESRSGRSYLPENRAVITQQGV TNWTYQELEATHQALTQEGYVFVGYHGTNHVAAQSIVNRISPVPRGSDTES ERAWGGLYVSTDASVAYGYARIQEGTADGGGLTPAERKARGVMLRVYLP QASLERFYRINADLEKERNLVERVIGHPLPLRNEAFTGTDAEEGSDETAIGW DMAIHGVAIPS |
| SEQ ID NO: 121 | VEDELNIFDECRSPCSLTPEPGKQIQSKLSIPSDVVLDEGVLYYSMTINDEQN DIKDEDKGESIITIGEFATVRATRHYVNQDAPFGVINLDITTENGTKTYSYNR KEGEFAINWLVPIGEDSPASIKISVDELDQQRNIIEVPKLYSIDLDNQTLEQW KTQGNVSFSVTRPEHNIAISWPSVSYKAAQKEGSRHKRWAHWHTGLALC WLVPIDAIYNYITQQNCTLGDNWFGGSYETVAGTPKAITVKQGIEQKPVEQ RIHFSKKNAMEALAAHRVCGVPLETLARSRKPRDLTDDLSCVYQAQNIVSL FVATRILFSHLDSVFTLNLDEQEPEVAERLSALRQINENNPGMVTQVLTVAR QIYNDYVTHHPGLTPEQTSAGAQAADILSLFCPDADKSCVASNNDQANINIE SRSGRSYLPENRAVITPQGVTNWTYQELEATHQALTREGYVFVGYHGTNH VAAQTIVNRIAPVPRGNNTENEKKWGGLYVATHAEVAHGYARIKEGTGEY GLPTRAERDARGVMLRV |
| SEQ ID NO: 122 | VEDELNIFDECRSPCSLTPEPGKPIQSKLSIPGDVVLDEGVLYYSMTINDEQN DIKDEDKGESIITIGEFATVRATRHYVSQDAPFGVINLDITTENGTKTYSFNR KEGEFAINWLVPIGEDSPASIKISIDELDQQRNIIEVPKLYSIDLDNQTLEQWE TQGNVSFAVTRPEQSIAISWPSVSYKAAEKDGARHKRWAHWHTGLALCW LVPLDAIYNYITQQNCTLGDNWFGGSYETVAGTPKAITVKQGMEQKPVEQ RIHFSKKNAMEALAAHRVCGVPLETLARGRKPRDLTDDLQCAYQAQNIVS LFLATRILFSHLDSVFTLNLDEQEPEVAERLTDLRRINENNPGMVTQVLTIA RQIYNDYVTEHPGLTPEQTSAGAQAADILSLLCPDADGSCVASNSDQANINI ESRSGRSYLPENRAVITPQGVTNWTYQELEAKHQTLTREGYVFVGYHGTN HVAAQSIVNRITPVPRGNNTEKEEEWGG |
| SEQ ID NO: 123 | VEDELNIFDECRSPCSLTPEPGKPIQSKLSIPGDVVLDEGVLYYSMTINDEQN DIKDEDKGESIITIGEFATVRATRHYVNQDAPFGVIHLDITTENGTKTYSFNR KEGEFAINWLVPIGEDSPASIKISIDELDQQRNIIEVPKLYSIDLDNQTLEQWE TQGNVSFAVTRPEQSIAISWPSVSYKAAEKDGARHKRWAHWHTGLALCW LVPLDAIYNYITQQNCTLGDNWFGGSYETVAGTPKAITVKQGMEQKPVEQ RIHFSKKNAMEALAAHRVCGVPLETLARGRKPRDLTDDLQCAYQAQNIVS LFLATRILFSHLDSVFTLNLDEQEPEVAERLTDLRRINENNPGMVTQVLTIA RQIYNDYVTEHPGLTPEQTSAGAQAADILSLFCPDADESCVASNSDQANINI ESRSGRSYLPENRAVITPQGVTNWTYQELEAKHQTLTREGYVFVGYHGTN HVAAQSIVNRITPVPRGNNTEKEEEWGG |
| SEQ ID NO: 124 | YSIDLDNQTLEQWKTQGNVSFSVTRPEHNIAISWPSVSYKAAQKEGSRHKR WAHWHTGLALCWLVPMDAIYNYITQQNCTLGDNWFGGSYETVAGTPKVI TVKQGIEQKPVEQRIHFSNGNAMSALAAHRVCGVPLETLARSRKPRDLTDD LSCAYQAQNIVSLFVATRILFSHLDSVFTLNLDEQEPEVAERLSDLRRINENN PGMVTQVLTVARQIYNDYVTHHPGLTPEQTSAGAQAADILSLFCPDADKSC VASNNDQANINIESRSGRSYLPENRAVITPQGVTNWTYQELEATHQALTRE GYVFVGYHGTNHVAAQTIVNRIAPVPRGNNTENEEKWGGLYVATHAEVA HGYARIKEGTGEYGLPTRAERDARGVMLRVYIPRASLERFYRTNTPLENAE EHITQVIGHSLPLRNEAFTGPESAGGEDETVIGWDMAIHAVAIPSTIPGNAYE ELAIDEEAVAKEQSISAKPPYKERKDELK |
| SEQ ID NO: 125 | VEDELNIFDECRSPCSLTPEPGKPIQSKLSIPSDVVLDEGVLYYSMTINDEQN DIKDEDKGESIITIGEFATVRATRHYVNQDAPFGVIHLDITTENGTKTYSYNR KEGEFAINWLVPIGEDSPASIKISVDELDQKRNIIEVPKLYSIDLDNQTLEQW ENQGNVSFAVTRPEQSIAISWPSVSYKAAHKNGSRHKRWANWLTTLPKVV LCFYEEPELCTYGEDWHGGAYKTVAGTPEAITVKQGIEQKTVEQRIHFSKK NAMEALAAHRVCGVPLETLARSRKPRDLQDDLSCAYQAQNIVSLFVATRIL FSHLDSVFTLNLDEQEPAVAERLSALRQINENNPGMVTQVLTVARQIYNDY VTHHPGLTPEQTSAGAQAADILSLFCPDADKSCVASNNDQANINIESRSGRS YLPENRAVITPQGVTNWTYQELEATHQALTREGYVFVGYHGTNHV |
| SEQ ID NO: 126 | VEEALNIFDECRSPCSLTPEPGKPIQSKLSIPGDVVLDEGVLYYSMTINDEQN DIKDEDKGESIITIGEFATVRATRHYVSQDAPFGVINLDITTENGTKTYSFNR |

TABLE 2-continued

| Additional cholix polypeptides | |
|---|---|
| | KESEFAINWLVPIGEDSPASIKISIDELDQQRNIIEVPKLYSIDLDNQTLEQWK<br>TQGNVSFSVTRPEHNIAISWPSVSYKAAQKEGSRHKRWAHWHTGLALCWL<br>VPIDAIYNYITQQNCTLGDNWFGGSYETVAGTPKAITVKQGIEQKPVEQRIH<br>FSKKNAMEALAAHRVCGVPLETLARSRKPRDLPDDLSCAYNAQQIVSLFLA<br>TRILFTHIDSIFTLNLDGQEPEVAERLDDLRRINENNPGMVIQVLTVARQIYN<br>DYVTHHPGLTPEQTSAGAQAADILSLFCPDADKSCVASNSDQANINIES |
| SEQ ID NO: 127 | LFSHLDSVFTLNLHEQEPAVAERLSALRQINENNPGMVTQVLTVARQIYND<br>YVTHHPGLTPEQTSAGAQAADILSLFCPDADKSCVASNNDQANINIESRSGR<br>SYLPENRAVITPQGVTNWTYQELEATHQALTREGYVFVGYHGTNHVAAQT<br>IVNRIAPVPRGNNTENEEKWGGLYVATHAEVAHGYARIKEGTGEYGLPTR<br>AERDARGVMLRVYIPRASLERFYRTNTPLENAEEHITQVIGHSLPLRNEAFT<br>GPESAGGEDETVIGWDMAIHAVAIPSTIPGNAYEELAIDEEAVAKEQSISAK<br>PPYKERKDELK |
| SEQ ID NO: 128 | AVITPQGVTNWTYQELEATHQALTREGYVFVGYHGTNHVAAQTIVNRIAP<br>VPRGNNTENEEKWGGLYVATHAEVAHGYARIKEGTGEYGLPTRAERDAR<br>GVMLRVYIPRASLERFYRTNTPLENAEEHITQVIGHSLPLRNEAFTGPESAG<br>GEDETVIGWDMAIHAVAIPSTIPGNAYEELAIDEEAVAKEQSISTKPPYKER<br>KDELK |
| SEQ ID NO: 129 | AVITPQGVTNWTYQELEATHQALTREGYVFVGYHGTNHVAAQTIVNRIAP<br>VPRGNNTENEEKWGGLYVATHAEVAHGYARIKEGTGEYGLPTRAERDAR<br>GVMLRVYIPRASLERFYRTNTPLENAEEHITQVIGHSLPLRNEAFTGPESAG<br>GEDETVIGWDMAIHAVAIPSTIPGNAYEELAIDEEAVAKEQSISTKPPYKER<br>KDEL |

TABLE 3

| FORMULA I | |
|---|---|
| SEQ ID NO:147 | X1-E-X3-X4-L-X6-I-F-D-E-C-R-S-P-C-X16-L-T-P-E-X21-G-K-X24-I-Q-S-<br>K-L-X30-I-P-X33-D-V-V-L-D-E-G-V-L-Y-Y-S-M-T-I-N-D-E-Q-N-D-I-<br>X56-D-E-X59-K-G-E-S-I-I-T-X67-G-E-F-A-T-X73-R-A-T-R-H-Y-V-X81-<br>Q-D-A-P-F-G-V-I-X90-L-D-I-T-T-E-N-G-T-K-X101-Y-S-X104-N-R-K-<br>X108-X109-E-F-X112-I-X114-W-L-V-X118-X119-G-E-D-S-P-A-S-I-K-I-S-<br>X131-D-E-X134-D-Q-X137-R-N-I-I-E-V-P-K-L-Y-S-I-D-L-D-N-Q-T-L-E-<br>Q-W-X160-X161-Q-G-N-V-X166-F-X168-V-T-R-P-E-X174-X175-I-A-I-S-<br>W-P-S-V-S-Y-X186-A-A-X189-K-X191-G-X193-R-H-K-R-W-A-X200-W-<br>X202-T-X204-X205-X206-X207-X208-X209-L-X211-X212-X213-X214-<br>X215-X216-X217-X218-X219-X220-X221-X222-X223-X224-C-T-X227-G-<br>X229-X230-W-X232-G-G-X235-Y-X237-T-V-A-G-X242-P-X244-X245-I-<br>X247-V-K-Q-G-X252-E-Q-K-X256-V-E-Q-R-I-H-F-S-X265-X266-N-A-<br>X269-X270-X271-L-A-A-H-R-V-C-G-V-P-L-E-T-L-A-R-X288-R-K-P-R-<br>X293-L-X295-D-D-L-X299-C-X301-Y-X303-A-Q-X306-I-V-S-L-F-X312-<br>A-T-R-X316-L-F-X319-H-X321-D-S-X324-F-T-L-N-L-X330-X331-Q-<br>X333-P-X335-V-X337-E-R-L-X341-X342-X343-R-X345-I-N-E-X349-N-P-<br>G-X353-V-X355-Q-V-L-T-X360-A-R-Q-I-Y-N-D-Y-V-T-X371-H-P-X374-<br>L-X376-P-E-Q-T-S-A-X383-A-Q-A-A-D-I-L-S-L-X393-X394-P-D-X397-D-<br>X399-X400-C-V-A-X404-X405-X406-D-Q-A-N-I-N-X413-E-S-R-S-G-R-S-<br>Y-L-X423-E-N-R-A-V-I-T-X431-Q-G-V-T-N-W-T-Y-Q-E-L-X443-X444-<br>X445-H-Q-X448-L-T-X451-E-X453-Y-V-F-V-G-Y-H-G-T-N-H-X465-A-A-<br>Q-X469-I-V-N-R-I-X475-P-V-P-R-G-X481-X482-T-E-X485-E-X487-X488- |

TABLE 3-continued

| FORMULA I |
|---|
| W-G-G-X492-Y-V-X495-T-X497-A-X499-X500-X501-X502-X503-Y-X505-R-X507-X508-X509-G-T-X512-X513-X514-X515-X516-X517-T-X519-X520-X521-X522-X523-X524-R-G-V-M-L-X530-V-Y-X533-X534-X535-A-S-L-E-R-F-Y-R-X544-N-X546-X547-L-E-X550-X551-X552-X553-X554-X555-X556-X557-V-I-G-H-X562-L-P-L-R-N-E-A-F-T-G-X573-X574-X575-X576-X577-G-X579-X580-E-T-X583-I-G-W-D-X588-A-I-X591-X592-V-A-I-P-S-T-I-P-G-N-X603-Y-X605-X606-L-X608-X609-X610-E-E-A-X614-A-X616-E-Q-S-I-S-X622-K-P-P-Y-K-E-X629-X630-D-E-L-K; |
| wherein X1 is selected from the group consisting of V and L; X3 is selected from the group consisting of E and D; X4 is selected from the group consisting of A and E; X6 is selected from the group consisting of N and K; X16 is selected from the group consisting of S and L; X21 is selected from the group consisting of P and L; X24 is selected from the group consisting of P and Q; X30 is selected from the group consisting of S and F; X33 is selected from the group consisting of S and G; X56 is selected from the group consisting of K and M; X59 is selected from the group consisting of D and G; X67 is selected from the group consisting of I and F; X73 is selected from the group consisting of V and I; X81 is selected from the group consisting of N and S; X90 is selected from the group consisting of H and N; X101 is selected from the group consisting of T and M; X104 is selected from the group consisting of Y and F; X108 is selected from the group consisting of E and D; X109 is selected from the group consisting of G and S; X112 is selected from the group consisting of A and T; X114 is selected from the group consisting of N and H; X118 is selected from the group consisting of P and I; X119 is selected from the group consisting of I and P; X131 is selected from the group consisting of V and I; X134 is selected from the group consisting L and I; X137 is selected from the group consisting Q and K; X160 is selected from the group consisting K and E; X161 is selected from the group consisting T and N; X166 is selected from the group consisting S and F; X168 is selected from the group consisting S and A; X174 is selected from the group consisting H and Q; X175 is selected from the group consisting N, S, SIAKQS (SEQ ID NO: 148), and SIAKQSIAKQS (SEQ ID NO: 149); X186 is selected from the group consisting of K and N; X189 is selected from the group consisting of Q, E, and H; X191 is selected from the group consisting of E, N, and D; X193 is selected from the group consisting of S and A; X200 is selected from the group consisting of H and N; X202 is selected from the group consisting of H, L, F, and R; X204 is selected from the group consisting of G and T; X205 is selected from the group consisting of L and S; X206 is selected from the group consisting of A and P; X207 is selected from the group consisting of L, E, and |

TABLE 3-continued

| FORMULA I |
|---|
| K; X208 is selected from the group consisting of C and V; X209 is selected from the group consisting of W, V, and T; X211 is selected from the group consisting of V and no amino acid; X212 is selected from the group consisting of P and no amino acid; X213 is selected from the group consisting of M, I, L, and no amino acid; X214 is selected from the group consisting of D and no amino acid; X215 is selected from the group consisting of A and no amino acid; X216 is selected from the group consisting of I and no amino acid; X217 is selected from the group consisting of Y and C; X218 is selected from the group consisting of N and F; X219 is selected from the group consisting of Y and F; X220 is selected from the group consisting of I and E; X221 is selected from the group consisting of T and D; X222 is selected from the group consisting of Q and P; X223 is selected from the group consisting of Q, E, and A; X224 is selected from the group consisting of N, L, and Q; X227 is selected from the group consisting of L and Y; X229 is selected from the group consisting of D and E; X230 is selected from the group consisting of N and D; X232 is selected from the group consisting of F, H, and Y; X235 is selected from the group consisting of S and A; X237 is selected from the group consisting of E and K; X242 is selected from the group consisting of T and I; X244 is selected from the group consisting of K, E, and G; X245 is selected from the group consisting of V and A; X247 is selected from the group consisting of T and M; X252 is selected from the group consisting of I and M; X256 is selected from the group consisting of P, T, and A; X265 is selected from the group consisting of K, Q, and N; X266 is selected from the group consisting of G and K; X269 is selected from the group consisting of M and I; X270 is selected from the group consisting of S and E; X271 is selected from the group consisting of A and T; X288 is selected from the group consisting of S and G; X293 is selected from the group consisting of D and Y; X295 is selected from the group consisting of T, P, and Q; X299 is selected from the group consisting of S and Q; X301 is selected from the group consisting of A and V; X303 is selected from the group consisting of Q and N; X306 is selected from the group consisting of N and Q; X312 is selected from the group consisting of V and L; X316 is selected from the group consisting of I and M; X319 is selected from the group consisting of S and T; X321 is selected from the group consisting of L and I; X324 is selected from the group consisting of V and I; X330 is selected from the group consisting of D, E, and H; X331 is selected from the group consisting of E and G; X333 is selected from the group consisting of E and A; X335 is selected from the group consisting of E and A; X337 is selected from the group consisting of A and T; X341 is selected from the group consisting of S, D, and T; X342 is selected |

TABLE 3-continued

| FORMULA I |
|---|
| from the group consisting of D and A; X343 is selected from the group consisting of L and I; X345 is selected from the group consisting of R and Q; X349 is selected from the group consisting of N and D; X353 is selected from the group consisting of M and V; X355 is selected from the group consisting of T and I; X360 is selected from the group consisting of V and I; X371 is selected from the group consisting of H and E; X374 is selected from the group consisting of G and L; X376 is selected from the group consisting of T and I; X383 is selected from the group consisting of G and S; X393 is selected from the group consisting of F and L; X394 is selected from the group consisting of C and Y; X397 is selected from the group consisting of A and T; X399 is selected from the group consisting of K, E, and G; X400 is selected from the group consisting of S, P, and H; X404 is selected from the group consisting of S and L; X405 is selected from the group consisting of N and D; X406 is selected from the group consisting of N and S; X413 is selected from the group consisting of I and V; X423 is selected from the group consisting of P and L; X431 is selected from the group consisting of P and Q; X443 is selected from the group consisting of E and D; X444 is selected from the group consisting of A and T; X445 is selected from the group consisting of T and K; X448 is selected from the group consisting of A and T; X451 is selected from the group consisting of R and Q; X453 is selected from the group consisting of G and D; X465 is selected from the group consisting of V and A; X469 is selected from the group consisting of T, S, and N; X475 is selected from the group consisting of A, S, and T; X481 is selected from the group consisting of N and S; X482 is selected from the group consisting of N and D; X485 is selected from the group consisting of N, S, and K; X487 is selected from the group consisting of E, R, and K; X488 is selected from the group consisting of K, A, and E; X492 is selected from the group consisting of L and V; X495 is selected from the group consisting of A and S; X497 is selected from the group consisting of H and D; X499 is selected from the group consisting of E and S; X500 is selected from the group consisting of V and L; X501 is selected from the group consisting of A and N; X502 is selected from the group consisting of H and Y; X503 is selected from the group consisting of G and R; X505 is selected from the group consisting of A and T; X507 is selected from the group consisting of I and L; X508 is selected from the group consisting of K and Q; X509 is selected from the group consisting of E and K; X512 is selected from the group consisting of G and A; X513 is selected from the group consisting of E, D, and N; X514 is selected from the group consisting of Y, G, A, and N; X515 is selected from the group consisting of G and E; X516 is selected from the group consisting of L and G; X517 is |

TABLE 3-continued

| FORMULA I |
|---|
| selected from the group consisting of P and L; X519 is selected from the group consisting of R, P, and T; X520 is selected from the group consisting of A and E; X521 is selected from the group consisting of E and K; X522 is selected from the group consisting of R, Q, and K; X523 is selected from the group consisting of D, K, and E; X524 is selected from the group consisting of A, T, and S; X530 is selected from the group consisting of R and K; X533 is selected from the group consisting of I and L; X534 is selected from the group consisting of P and H; X535 is selected from the group consisting of R and Q; X544 is selected from the group consisting of T and I; X546 is selected from the group consisting of T, A, and I; X547 is selected from the group consisting of P and D; X550 is selected from the group consisting of N and K; X551 is selected from the group consisting of A and E; X552 is selected from the group consisting of E, R, and D; X553 is selected from the group consisting of E, N, and R; X554 is selected from the group consisting of H and L; X555 is selected from the group consisting of I and V; X556 is selected from the group consisting of T and E; X557 is selected from the group consisting of Q, R, H, and D; X562 is selected from the group consisting of S and P; X573 is selected from the group consisting of P and T; X574 is selected from the group consisting of E and D; X575 is selected from the group consisting of S, A, and R; X576 is selected from the group consisting of A, E, and V; X577 is selected from the group consisting of G, E, and D; X579 is selected from the group consisting of E and S; X580 is selected from the group consisting of D and N; X583 is selected from the group consisting of V and A; X588 is selected from the group consisting of M and I; X591 is selected from the group consisting of H and Y; X592 is selected from the group consisting of A and G; X603 is selected from the group consisting of A and S; X605 is selected from the group consisting of E and A; X606 is selected from the group consisting of E, A, Q, G, V, and R; X608 is selected from the group consisting of A, P, and T; X609 is selected from the group consisting of I, T, and P; X610 is selected from the group consisting of D and A; X614 is selected from the group consisting of V and VVKEAI (SEQ ID NO: 150); X616 is selected from the group consisting of K and E; X622 is selected from the group consisting of T, A, and P; andX629 is selected from the group consisting of R, Q, and H; and X630 is selected from the group consisting of K and no amino acid. |

TABLE 4

| Exemplary Transcytosing Carriers Identifying Amino Acid Residues of any one of SEQ ID NOs: 20-147 AA residues |
|---|
| 1-195 |
| 1-196 |
| 1-197 |
| 1-198 |
| 1-199 |
| 1-200 |
| 1-201 |
| 1-202 |
| 1-203 |
| 1-204 |
| 1-205 |
| 1-206 |
| 1-207 |
| 1-208 |
| 1-209 |
| 1-210 |
| 1-211 |
| 1-212 |
| 1-213 |
| 1-214 |
| 1-215 |
| 1-216 |
| 1-217 |
| 1-218 |
| 1-219 |
| 1-220 |
| 1-221 |
| 1-222 |
| 1-223 |
| 1-224 |
| 1-225 |
| 1-226 |
| 1-227 |
| 1-228 |
| 1-229 |
| 1-230 |
| 1-231 |
| 1-232 |
| 1-233 |
| 1-234 |
| 1-235 |
| 1-236 |
| 1-237 |
| 1-238 |
| 1-239 |
| 1-240 |
| 1-241 |
| 1-242 |
| 1-243 |
| 1-244 |
| 1-245 |
| 1-246 |
| 1-247 |
| 1-248 |
| 1-249 |
| 1-250 |
| 1-251 |
| 1-252 |
| 1-253 |
| 1-254 |
| 1-255 |
| 1-256 |
| 1-257 |
| 1-258 |
| 1-259 |
| 1-260 |
| 1-261 |
| 1-262 |
| 1-263 |
| 1-264 |
| 1-265 |
| 1-266 |
| 1-267 |
| 1-268 |
| 1-269 |
| 1-270 |

TABLE 4-continued

| Exemplary Transcytosing Carriers Identifying Amino Acid Residues of any one of SEQ ID NOs: 20-147 AA residues |
|---|
| 1-271 |
| 1-272 |
| 1-273 |
| 1-274 |
| 1-275 |
| 1-276 |
| 1-277 |
| 1-278 |
| 1-279 |
| 1-280 |
| 1-281 |
| 1-282 |
| 1-283 |
| 1-284 |
| 1-285 |
| 1-286 |
| 1-287 |
| 1-288 |
| 1-289 |
| 1-290 |
| 1-291 |
| 1-292 |
| 1-293 |
| 1-294 |
| 1-295 |
| 1-296 |
| 1-297 |
| 1-298 |
| 1-299 |
| 1-300 |
| 1-301 |
| 1-302 |
| 1-303 |
| 1-304 |
| 1-305 |
| 1-306 |
| 1-307 |
| 1-308 |
| 1-309 |
| 1-310 |
| 1-311 |
| 1-312 |
| 1-313 |
| 1-314 |
| 1-315 |
| 1-316 |
| 1-317 |
| 1-318 |
| 1-319 |
| 1-320 |
| 1-321 |
| 1-322 |
| 1-323 |
| 1-324 |
| 1-325 |
| 1-326 |
| 1-327 |
| 1-328 |
| 1-329 |
| 1-330 |
| 1-331 |
| 1-332 |
| 1-333 |
| 1-334 |
| 1-335 |
| 1-336 |
| 1-337 |
| 1-338 |
| 1-339 |
| 1-340 |
| 1-341 |
| 1-342 |
| 1-343 |
| 1-344 |
| 1-345 |
| 1-346 |

TABLE 4-continued

| Exemplary Transcytosing Carriers Identifying Amino Acid Residues of any one of SEQ ID NOs: 20-147 AA residues |
|---|
| 1-347 |
| 1-348 |
| 1-349 |
| 1-350 |
| 1-351 |
| 1-352 |
| 1-353 |
| 1-354 |
| 1-355 |
| 1-356 |
| 1-357 |
| 1-358 |
| 1-359 |
| 1-360 |
| 1-361 |
| 1-362 |
| 1-363 |
| 1-364 |
| 1-365 |
| 1-366 |
| 1-367 |
| 1-368 |
| 1-369 |
| 1-370 |
| 1-371 |
| 1-372 |
| 1-373 |
| 1-374 |
| 1-375 |
| 1-376 |
| 1-377 |
| 1-378 |
| 1-379 |
| 1-380 |
| 1-381 |
| 1-382 |
| 1-383 |
| 1-384 |
| 1-385 |
| 1-386 |
| 1-387 |
| 1-388 |
| 1-389 |
| 1-390 |
| 1-391 |
| 1-392 |
| 1-393 |
| 1-394 |
| 1-395 |
| 1-396 |
| 1-397 |
| 1-398 |
| 1-399 |
| 1-400 |
| 1-401 |
| 1-402 |
| 1-403 |
| 1-404 |
| 1-405 |
| 1-406 |
| 1-407 |
| 1-408 |
| 1-409 |
| 1-410 |
| 1-411 |
| 1-412 |
| 1-413 |
| 1-414 |
| 1-415 |

Methods of Manufacture

Figure 2A:
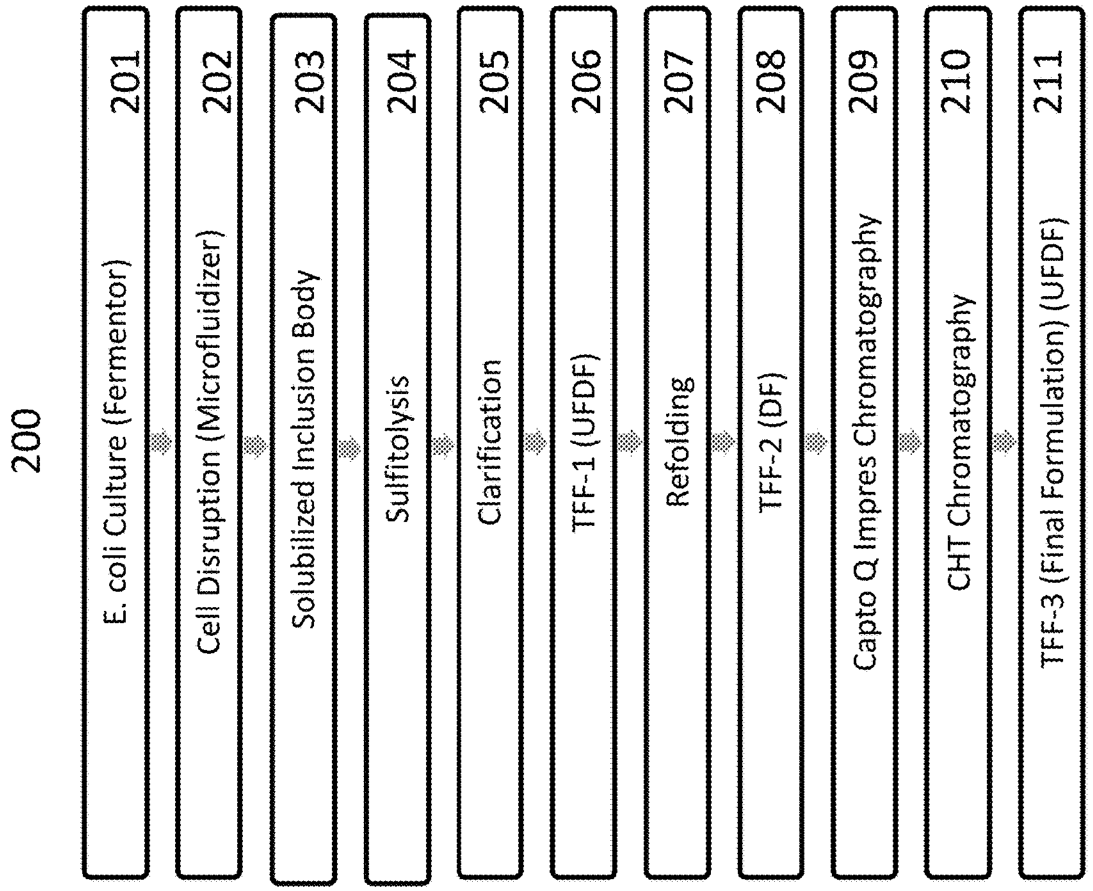
FIGS. 2A-2B illustrate an exemplary process for expressing, refolding, and purifying IL-10 or IL-10 delivery constructs.

In one embodiment, expression, isolation, purification and refolding (e.g., of an IL-10 delivery construct) can be performed according to the process outlined in FIG. 2A. In another embodiment, expression, isolation, purification and refolding (e.g., of an IL-10 delivery construct) can be performed according to the process outline in FIG. 2B.

Figure 2B:
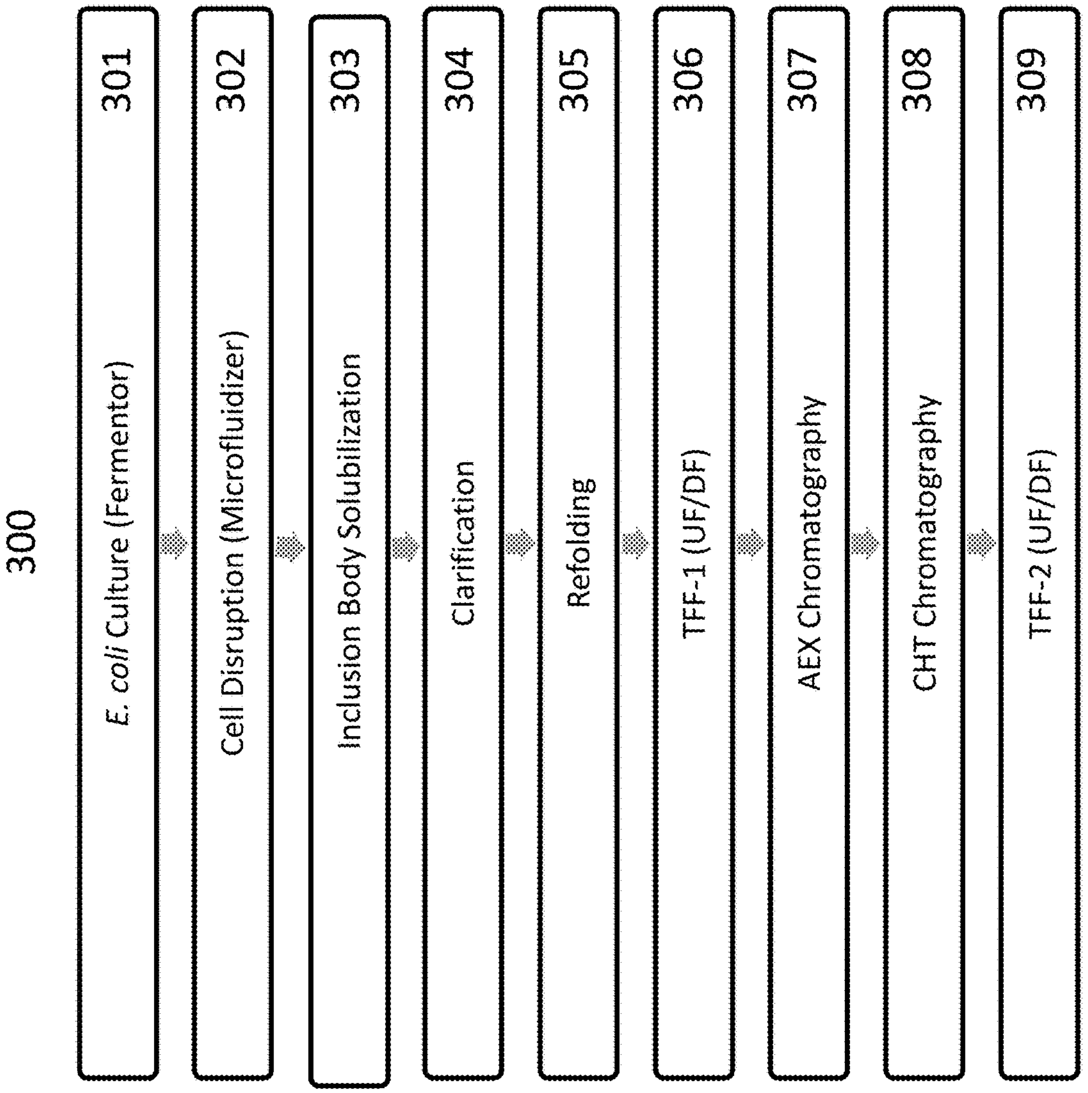

In step 201 in FIG. 2A or step 301 in FIG. 2B cells are engineered and cultured to recombinantly express an IL-10 delivery construct, such as SEQ ID NO: 5, by transforming the cells with a plasmid encoding the IL-10 delivery construct. In some embodiments, the plasmid includes a nucleic acid corresponding to the sequence in SEQ ID NO. 10 (or a sequence having at least 90%, at least 92%, at least 95%, at least 98%, or at least 99% sequence identity thereto), which is a codon-improved sequence for expression in bacteria. The plasmid can further comprise a marker for antibiotic resistance. The antibiotic to which the plasmid can confer resistance can be kanamycin, ampicillin, tetracycline, or chloramphenicol. In some instances, the cells are bacterial cells. The bacterium can be *Escherichia coli*. Transformed cells can further be expanded. The expansion of the transformed cells can be clonal expansion. The expanded cells can be transferred into a production bioreactor for fermentation. The fermentation can occur in a 1500 L bioreactor. In some embodiments, the fermentation occurs in the presence of the antibiotic to which the plasmid confers resistance. Production fermentation can comprise a cell growth phase followed by an expression phase. The expression phase can comprise the use of isopropyl β-D-1-thiogalactopyranoside (IPTG) as an inducer. The IL-10 delivery construct can be expressed intracellularly as insoluble inclusion bodies. At the end of production, the cells can be harvested by centrifugation. This centrifugation can produce a first pellet comprising the cells. The first pellet can be resuspended in a first buffer. The first buffer can comprise from 40 mM to 60 mM of Tris, preferably 50 mM. The first buffer can range from a pH of 7.5 to 8.5, preferably a pH of 8.0. The first buffer can further comprise from 15 mM to 25 mM of EDTA, preferably 20 mM EDTA. The weight ratio of cells in the first pellet to first buffer can be from 1:4 to 1:6, preferably 1:5. The first pellet can be mixed in the first buffer for from 50 to 70 minutes, preferably 60 minutes, until a homogenous mixture is obtained.

In step 202 in FIG. 2A or step 302 in FIG. 2B, the cultured cells are disrupted e.g., by lysing to release the inclusion bodies. The lysing can comprise high-pressure homogenization. The high-pressure homogenization can occur in a microfluidizer. The high-pressure homogenization can occur from 16,000 to 20,000 psi, or about 18,000 psi. Two rounds of lysis can occur in order to ensure that substantially all cells have been lysed. The lysed cells can be centrifuged from 6000 to 10,000 rpm, or about 8000 rpm. Centrifugation can occur for 30 to 50 minutes, or about 40 minutes and can produce a second pellet.

The supernatant can be removed, and the second pellet can be resuspended in a second buffer. The second buffer can comprise from 40 mM to 60 mM of Tris, preferably 50 mM. The second buffer can range from a pH of 7.5 to 8.5, preferably a pH of 8.0. The second buffer can further comprise from 15 mM to 25 mM of EDTA, preferably 20 mM EDTA. The second buffer can further comprise from 2% to 3% of Trion X-100, preferably 2.5%. The second buffer can further comprise from 450 mM to 550 mM of NaCl, preferably 500 mM. The weight ratio of the second pellet to second buffer can be from 1:4 to 1:6, preferably 1:5. The resuspension of the second pellet in the second buffer can be centrifuged from 6000 to 10,000 rpm, or about 8000 rpm. Centrifugation can occur for 15 to 25 minutes, or about 20 minutes and can produce a third pellet.

The supernatant can be removed, and the third pellet can be resuspended in a third buffer. The third buffer can comprise from 40 mM to 60 mM of Tris, preferably 50 mM.

The third buffer can range from a pH of 7.5 to 8.5, preferably a pH of 8.0. The third buffer can further comprise from 15 mM to 25 mM of EDTA, preferably 20 mM EDTA. The weight ratio of the third pellet to third buffer can be from 1:4 to 1:6, preferably 1:5. The resuspension of the third pellet in the third buffer can be centrifuged from 6000 to 10,000 rpm, or about 8000 rpm. Centrifugation can occur for 15 to 25 minutes, or about 20 minutes and can produce a fourth pellet.

The supernatant can be removed, and the fourth pellet can be resuspended in a fourth buffer. The fourth buffer can comprise from 40 mM to 60 mM of Tris, preferably 50 mM. The fourth buffer can range from a pH of 7.5 to 8.5, preferably a pH of 8.0. The weight ratio of the fourth pellet to fourth buffer can be from 1:4 to 1:6, preferably 1:5. The resuspension of the fourth pellet in the fourth buffer can be centrifuged from 6000 to 10,000 rpm, or about 8000 rpm. Centrifugation can occur for 35 to 55 minutes, or about 45 minutes and can produce a fifth pellet. The fifth pellet can comprise the inclusion bodies comprising the IL-10 delivery complex. The fifth pellet comprising the IL-10 delivery constructs can be frozen prior to further use. The constructs can be frozen from −15° C. to −25° C., preferably −20° C.

In step 203 in FIG. 2A or step 303 in FIG. 2B, the inclusion bodies with the IL-10 delivery construct are solubilized using a solubilization solution. The solubilization solution can comprise a chaotropic agent. The solubilization solution can comprise the chaotropic agent in a concentration from 5 M to 8 M, from 6 M to 7 M, about 6.6 M, or about 6 M. The chaotropic agent can comprise guanidine hydrochloride, urea, or a combination thereof. The chaotropic agent can comprise a hydrochloride salt of guanidine. The solubilization solution can further comprise Tris. The solubilization solution can comprise Tris in a concentration from 40 mM to 60 mM, or about 50 mM. The solubilization solution can be at a pH from 7 to 9 or at about 8. The solubilization solution can be added to the pellet comprising the 10 delivery constructs obtained following the lysing of the cell. A ratio of the pellet comprising the IL-10 delivery constructs to the solubilization solution can be from 1:8 to 1:12 or at about 1:10 (w/w). The solubilization can be allowed to mix for at least or about 60 mins.

In some embodiments, as shown in step 204 in FIG. 2A, the IL-10 delivery construct is modified by a sulfitolysis agent or a reducing agent. Such modification may occur concurrent with or subsequent to solubilization of the inclusions bodies as depicted in step 203. In some instances, a sulfitolysis agent or a reducing agent is added to the solubilization solution prior to contacting the inclusion bodies with the solubilization solution. In such instances, the solubilization and sulfitolysis/reduction steps may occur at the same time. In other embodiments, the inclusion bodies are first solubilized in a solubilization solution, and the sulfitolysis agent or reducing agent is subsequently added. Stated differently, the sulfitolysis or reducing agent may be added after the IL-10 delivery constructs has been substantially solubilized. In some embodiments, the sulfitolysis agent comprises sodium sulfite. For instance, in some embodiments, the can comprise adding sodium sulfite to the solubilization solution. In some embodiments, from 30 mM to 50 mM, from 35 mM to 45 mM, from 38 mM to 42 mM, or about 40 mM of sodium sulfite is added to the solubilization solution. In some embodiments, the method comprises incubating the solubilization solution comprising the sodium sulfite for from 25 to 35 minutes or more preferably for about 30 minutes. The incubating the solubilization solution comprising the sodium sulfite can occur at room temperature. Potassium tetrathionate can then be added to the solubilization solution. The potassium tetrathionate can be added to the solubilization solution after addition of the sodium sulfite. In some embodiments, from 23 mM to 43 mM, from 28 mM to 38 mM, from 31 mM to 35 mM, or about 33 mM of potassium tetrathionate is added to the solubilization solution. Potassium tetrathionate can be mixed with the solubilization solution for from 55 to 65 minutes or about 60 minutes. This mixing and incubation can occur at room temperature. Higher yields of an IL-10 delivery construct in dimer form may be obtained when a sulfitolysis agent is used for disruption of disulfide bonds relative to when DTT is used for disruption of disulfide bonds. For example, use of the sulfitolysis agent may result, upon refolding, in a yield of the IL-10 delivery construct in a dimer form that is at least 2-fold higher than the yield obtained, after refolding, when DTT is used for reduction/disruption. For example, when IL-10 delivery constructs are processed using DTT for reduction, less than 5% of the resulting yield of IL-10 delivery constructs may be in dimer form, whereas IL-10 delivery constructs processed using a sulfitolysis agent may result in greater than 10% of the resulting yield of IL-10 delivery constructs in dimer form.

In some embodiments, step 204 in FIG. 2A is optional (or explicitly absent). Stated differently, in some embodiments, the solubilized IL-10, IL-10 delivery constructs, or solubilized inclusion bodies containing IL-10 or IL-10 delivery constructs are processed (e.g., clarified, concentrated, and/or delivered to a refolding solution) without treatment or contact with a reducing agent or a sulfitolysis agent (FIG. 2B). In other words, in some embodiments, the inclusion bodies (IBs) are solubilized with a chaotrophic agent and subsequently diluted into a refolding solution (e.g., a redox cocktail) without subjecting the inclusion bodies to a reducing agent or a sulfitolysis agent.

The method can comprise clarifying the solubilized and/or reduced IL-10 delivery constructs to produce a clarified IL-10 delivery constructs (step 205 in FIG. 2A or step 304 in FIG. 2B). Clarification can comprise removal of residual insoluble material following the solubilization and sulfitolysis and can occur prior to subsequent downstream purification steps. The clarifying can comprise depth filtration. The clarifying can comprise a primary clarification. The primary clarification can comprise filtering solubilized and/or the reduced IL-10 delivery constructs through a filter with a 0.5 μm to 10 μm nominal rating. The clarifying can comprise a secondary clarification. The secondary clarification can occur after the primary clarification. The secondary clarification can comprise filtering the solubilized and/or reduced IL-10 delivery constructs through a filter, such as a filter with a 0.2 μm to 2 μm nominal rating. The method can further comprise performing a sterile filtration of the solubilized and/or reduced IL-10 delivery constructs. The sterile filtration can comprise filtration through a filter with a pore size from 0.1 μm to 0.3 μm. The filter can be a capsule filter. The performing the sterile filtration can occur after the clarifying.

The method can comprise performing a tangential flow filtration step between the clarification and refolding steps. The tangential flow filtration step between the clarification and refolding steps can comprise the first tangential flow filtration (TFF-1) of step 206 in FIG. 2A. The method can comprise performing a tangential flow filtration step between the clarification and refolding steps of the solubilized and/or reduced IL-10 delivery constructs. In some embodiments, when a sulfitolysis agent is not used, the method does not comprise a tangential flow filtration step between the clarification and refolding steps (FIG. 2B). Stated differently, in some embodiments, step 206 is explicitly absent when step 205 is also absent (FIG. 2A).

In some cases, purification without use of a sulfitolysis agent or a reducing agent produces a higher IL-10 delivery construct dimer percentage compared to solubilization using sulfitolysis or a reducing agent. In some cases, purification without use of sulfitolysis or a reducing agent produces a higher IL-10 delivery construct yield compared to solubilization by sulfitolysis or with a reducing agent. In some cases, purification without use of a sulfitolysis agent or a reducing agent produces fewer IL-10 delivery construct HMW aggregates compared to solubilization using sulfitolysis or a reducing agent.

Furthermore, in some embodiments, purification without the use of a sulfitolysis agent or a reducing agent does not require a tangential flow filtration step between the clarification and refolding steps, which can shorten the purification process by about 1 or 2 days. Not performing the tangential flow filtration step between the clarification and refolding steps can prevent a loss of from 10% to 40%, from 10% to 15%, from 15% to 30%, or from 30% to 35% of the purified IL-10 delivery construct relative to a purification process including sulfitolysis and a tangential flow filtration step between the clarification and refolding steps.

The first tangential flow filtration step between the clarification and refolding steps can occur after the clarifying. The tangential flow filtration step between the clarification and refolding steps can occur after the sterile filtration of the solubilized and/or reduced IL-10 delivery constructs. The tangential flow filtration step between the clarification and refolding steps can comprise ultrafiltration. The ultrafiltration can comprise concentration of the IL-10 delivery constructs to from 15 mg/mL to 25 mg/mL, from 18 mg/mL to 22 mg/mL, or about 20 mg/mL. The ultrafiltration can occur at occur at a transmembrane pressure (TMP) from 10 to 20 psi, from 12 to 18 psi, or about 15 psi. The tangential flow filtration step between the clarification and refolding steps can comprise diafiltration. The diafiltration can occur after the ultrafiltration. The tangential flow filtration step between the clarification and refolding steps can comprise ultrafiltration and diafiltration (UF/DF). The diafiltration can comprise a first diavolume, a second diavolume, a third diavolume, a fourth diavolume, and a fifth diavolume. The first diavolume, second diavolume, third diavolume, fourth diavolume, and fifth diavolume can comprise a buffer. The buffer can comprise a chaotropic agent. The buffer can comprise from 3.5 M to 4.5 M of the chaotrophic agent, preferably 4 M. The chaotropic agent can be guanidine HCl. The buffer can comprise Tris. The buffer can comprise from 40 mM to 60 mM Tris, preferably 50 mM. The buffer can have a pH from 7 to 8.5. The diafiltration can occur at occur at a transmembrane pressure (TMP) from 10 to 20 psi, from 12 to 18 psi, or about 15 psi.

The method can comprise contacting the solubilized and/or reduced IL-10 delivery constructs with a refolding solution to produce a refolded IL-10 delivery constructs (step 207 in FIG. 2A or step 305 in FIG. 2B). The solubilized and/or reduced IL-10 delivery constructs can be in a retentate obtained following the tangential flow filtration step between the clarification and refolding steps of the solubilized and/or reduced IL-10 delivery constructs. The refolding solution can comprise reduced glutathione and oxidized glutathione. The ratio (w/w) of reduced glutathione to oxidized glutathione can be from 0.8:1 to 1.2:1, preferably 1:1. The molar ratio of reduced glutathione to oxidized glutathione can be from 0.8:2 to 1.1:2, preferably 1:2. In some embodiments, the refolding solution comprises from 0.75 mM to 1.5 mM reduced glutathione, preferably 1.0 mM. In some embodiments, the refolding solution comprises from 0.25 mM to 0.75 mM oxidized glutathione, preferably 0.5 mM. In some embodiments, the refolding solution comprises arginine, sucrose, Tris, EDTA, or a combination thereof. The refolding solution can comprise from 900 mM to 1.1 M of arginine, preferably 1M. In some embodiments, the arginine is arginine-HCl. The refolding solution can comprise from 200 mM to 300 mM of sucrose, preferably 250 mM. The refolding solution can comprise from 75 mM to 125 mM of Tris, preferably 100 mM. The Tris can have a pH of about 8.5. The refolding solution can comprise from 1.75 mM to 2.25 mM of EDTA, preferably 2 mM. In some embodiments, the refolding solution comprises polyethylene glycol (PEG). In some embodiments from 0.1% to 0.3% (w/w) of the refolding solution is polyethylene glycol (PEG), preferably 0.2%. The PEG can be PEG 3350. The refolding solution can comprise a pH from about 7.5 to about 8.5. The refolding solution can comprise a pH of about 8.0. The refolding solution can comprise a pH of about 8.5. The retentate obtained following the tangential flow filtration step between the clarification and refolding steps can be mixed with the refolding solution over the course of from 50 to 70 minutes, preferably 60 minutes, to reach a target concentration of the IL-10 delivery constructs of from 0.8 mg/mL to 1.2 mg/mL, preferably 1 mg/mL. Subsequent contacting with the refolding solution can occur from 12 hours to 18 hours. The contacting with the refolding solution can occur for at least 16 hours. The refolding solution can be at a temperature from 2° C. to 8° C., or at about 4° C., during the contacting. The refolding solution can be pre-chilled to a temperature from 2° C. to 8° C., or at about 4° C., prior to the contacting. The contacting can produce refolded IL-10 delivery constructs.

The method can comprise performing a first sterile filtering of the refolded IL-10 delivery constructs. The first sterile filtering can comprise filtration through a filter with a pore size from 0.1 μm to 0.3 μm, preferably 0.2 μm. The filter can be a capsule filter. The first sterile filtering of the refolded IL-10 delivery constructs can occur prior to a tangential flow filtration step between the refolding and anion exchange (AEX) chromatography steps.

In some embodiments, IL-10 delivery construct dimers may be stored in buffer, for example at 25° C. for two days. Such a buffer may comprise a salt such as 1×PBS, 150 mM, or 200 mM NaCl buffered in 10 mM Sodium Phosphate at pH 7.0. IL-10 delivery construct dimers may be more stable when stored in a buffer comprising a salt such as 1×PBS, 150 mM, or 200 mM NaCl buffered in 10 mM Sodium Phosphate at pH 7.0 than in a buffer comprising 10 mM Sodium Phosphate at pH 7.0 alone.

The method can comprise performing a tangential flow filtration step between the refolding and anion exchange (AEX) chromatography steps. The tangential flow filtration step between the refolding and anion exchange (AEX) chromatography steps can comprise the second tangential flow filtration (TFF-2) of step 208 in FIG. 2A or the first tangential flow filtration (TFF-1) of step 306 of FIG. 2B. The tangential flow filtration step between the refolding and anion exchange (AEX) chromatography steps can occur after the first sterile filtering. The tangential flow filtration step between the refolding and anion exchange (AEX) chromatography steps can comprise ultrafiltration. The ultrafiltration can occur at occur at a transmembrane pressure (TMP) from 10 to 20 psi, from 12 to 18 psi, or about 15 psi. The tangential flow filtration step between the refolding and anion exchange (AEX) chromatography steps can comprise diafiltration. The diafiltration can occur after the ultrafiltration. The tangential flow filtration step between the refolding and anion exchange (AEX) chromatography steps can comprise ultrafiltration and diafiltration (UF/DF). The diafiltration can comprise a first diavolume, a second diavolume, a third diavolume, and a fourth diavolume. The first diavolume and the second diavolume can comprise a cold buffer (e.g., from 2-8 degrees C., or at about 4° C.). The third diavolume and the fourth diavolume can comprise a room temperature buffer. The cold buffer and the room temperature buffer can comprise Tris and NaCl. The Tris can be in a concentration from 20 mM to 30 mM, preferably 25 mM. The NaCl can be in a concentration from 75 mM to 125 mM, preferably 100 mM. The cold buffer and the room temperature buffer can be at a pH from 7 to 8, preferably 7.5. The retentate obtained following the tangential flow filtration step between the refolding and anion exchange (AEX) chromatography steps can be held overnight at room temperature. The retentate obtained following the tangential flow filtration step between the refolding and anion exchange (AEX) chromatography steps can be held overnight from 2° C. to 8° C. or at about 4° C. The retentate obtained following the tangential flow filtration step between the refolding and anion exchange (AEX) chromatography steps can comprise the refolded IL-10 delivery construct.

The method can comprise performing a second sterile filtering of the refolded IL-10 delivery construct. The second sterile filtering can comprise filtering the retentate obtained following the tangential flow filtration step between the refolding and anion exchange (AEX) chromatography steps through a filter with a pore size from 0.1 μm to 0.3 μm. The filter can be a capsule filter. The second sterile filtering of the refolded IL-10 delivery construct can occur after the tangential flow filtering step between the refolding and anion exchange (AEX) chromatography steps.

In some embodiments, the steps in the method, from refolding up to and including the tangential flow filtration step between the refolding and anion exchange (AEX) chromatography steps, are carried out at a temperature from 2° C. to 8° C. or from 3° C. to 5° C. In some embodiments, the steps in the method, from refolding up to and including the tangential flow filtration step between the refolding and anion exchange (AEX) chromatography steps, are carried out at a temperature of about 4° C. The method can comprise performing anion exchange (AEX) chromatography (step 209 in FIG. 2A or step 307 in FIG. 2B) on retentate obtained following the tangential flow filtration step between the refolding and anion exchange (AEX) chromatography steps. Performing AEX chromatography can comprise binding the IL-10 delivery construct dimers to an anion exchange column and subsequently eluting the IL-10 delivery construct dimers from the anion exchange column. Performing AEX chromatography on the pool of IL-10 delivery constructs can thereby create a first plurality of fractions of IL-10 delivery constructs. The AEX chromatography can be Capto™ Q ImpRes.

The percentage of IL-10 delivery constructs in dimer form in each fraction of the first plurality of fractions is determined using, for example, size exclusion chromatography (SEC), such as size exclusion high performance liquid chromatography (SE-HPLC). The percentage of IL-10 delivery constructs in a dimer form can be compared to a first threshold. The first threshold can be 70%, at least 75%, at least 80%, at least 85%, or at least 90%. Preferably, the first threshold can be 75%. Any fraction containing a percentage of IL-10 delivery construct dimers greater than the threshold can be pooled into a first enriched pool.

The method can comprise performing a ceramic hydroxyapatite (CHT) chromatography step on the first enriched pool (step 210 in FIG. 2A or step 308 in FIG. 2B). Performing CHT chromatography on the first enriched pool can thereby create a second plurality of fractions of IL-10 delivery constructs in the dimer form. In some embodiments, the concentration of the IL-10 delivery constructs in the second plurality of fractions is from about 15 mg/mL to about 25 mg/mL or about 20 mg/mL. In some embodiments, the method does not comprise cation exchange chromatography. In some embodiments, the method does not comprise gel filtration chromatography.

The percentage of IL-10 delivery constructs in dimer form in each fraction of the second plurality of fractions is determined using, for example, size exclusion chromatography (SEC), such as size exclusion high performance liquid chromatography (SE-HPLC). The percentage of IL-10 delivery constructs in dimer form can be compared to a second threshold. The second threshold can be at least 75%, at least 80%, at least 85%, at least 90%, or at least 95%. Preferably, the second threshold can be 80%. Any fraction containing a percentage of IL-10 delivery construct dimers greater than the threshold can be pooled into a second enriched pool. The percentage of IL-10 delivery constructs in the second enriched pool can be greater than the percentage of IL-10 delivery constructs in the first enriched pool. The second enriched pool can comprise greater than 80%, greater than 85%, or greater than 90% of the IL-10 delivery constructs in a dimer form.

The method can comprise a first sterile filtering of the second enriched pool. The first sterile filtering of the second enriched pool can comprise filtration through a filter, such as a filter with a pore size from 0.1 μm to 0.3 μm. The filter can be a capsule filter.

The method can comprise performing a tangential flow filtration step after the ceramic hydroxyapatite chromatography step. The tangential flow filtration step after the ceramic hydroxyapatite chromatography step can comprise the third tangential flow filtration (TFF-3) of step 211 in FIG. 2A or the second tangential flow filtration (TFF-2) of step 309 of FIG. 2B. The tangential flow filtration step after the ceramic hydroxyapatite chromatography step can comprise ultrafiltration. The ultrafiltration can occur at occur at a transmembrane pressure (TMP) from 10 to 20 psi, from 12 to 18 psi, or about 15 psi. The tangential flow filtration step after the ceramic hydroxyapatite chromatography step can comprise diafiltration. The diafiltration can occur after the ultrafiltration. The tangential flow filtration step after the ceramic hydroxyapatite chromatography step can comprise ultrafiltration and diafiltration (UF/DF). The diafiltration can comprise a first diavolume, a second diavolume, a third diavolume, a fourth diavolume, and a fifth diavolume. The first diavolume, second diavolume, third diavolume, fourth diavolume, and fifth diavolume can comprise a buffer. The buffer can be a lyophilization buffer. The buffer can comprise a salt, a bulking agent, and an osmolyte. The buffer can comprise from 8 mM to 12 mM salt, preferably 10 mM. The buffer can comprise from 1% to 3% bulking agent, preferably 2%. The buffer can comprise from 0.5% to 1.5% osmolyte, preferably 1%. The salt can be potassium phosphate. The bulking agent can be glycine. The osmolyte can be sucrose. The method can comprise a second sterile filtering. The second sterile filtering can be performed after the diafiltration. The method can comprise adding a surfactant to the buffer. The surfactant can be added after the second sterile filtering. Following the addition of the surfactant to the buffer, the buffer can comprise from 0.2% to 0.4% of the surfactant, preferably 0.3%. The surfactant can be a poloxamer. The poloxamer can be poloxamer 188. In some embodiments, the mixture of the buffer with the refolded IL-10 delivery constructs can be the liquid composition previously described herein. The tangential flow filtration step after the ceramic hydroxyapatite chromatography step can occur after the first sterile filtering of the second enriched pool. The method can comprise performing a second sterile filtering of the second enriched pool. The second sterile filtering can comprise filtration through a filter, such as a filter with a pore size from 0.1 μm to 0.3 μm, preferably 0.2 μm. The filter can be a capsule filter. The second sterile filtering can occur after the tangential flow filtration step after the ceramic hydroxyapatite chromatography step. The retentate obtained following the third tangential flow filtration can be frozen from −70° C. to −90° C., preferably −80° C. The retentate obtained following the tangential flow filtration step after the ceramic hydroxyapatite chromatography step can be the liquid composition described herein. The retentate obtained following the third tangential flow filtration can comprise greater than 80%, greater than 85%, or greater than 90% of the IL-10 delivery constructs in a dimer form.

In some cases, the method can comprise performing cation exchange chromatography, for example with a Sulfate 650F column. The cation exchange chromatography step may be performed after an anion exchange chromatography step and a ceramic hydroxyapatite (CHT) purification step, before an anion exchange chromatography step and a ceramic hydroxyapatite (CHT) purification step, or between an anion exchange chromatography step and a ceramic hydroxyapatite (CHT) purification step. As shown in Example 39 and Table 61, performing a cation exchange chromatography step, followed by an anion exchange chromatography step and a ceramic hydroxyapatite (CHT) purification step resulted in recovery of 20% of the IL-10 delivery construct dimers with 96% purity.

Oral Formulations

The solutions herein comprising high levels of a dimer form of IL-10 (whether alone or as part of an IL-10 delivery construct) can be further processed for oral administration.

First, such solutions can be dried by a process that does not involve concentration of the IL-10 delivery construct in a solution, examples of such a process include lyophilization (freeze-drying, (FD)) or spray drying (SD), to produce a dry or solid form of the IL-10/IL-10 delivery construct composition. Freeze-drying can be conducted using a Virtis Advantage manifold lyophilizer, with Intellitronics software. Glass vials containing a frozen therapeutic protein formulation can be partially stoppered with a neoprene lyo-stopper, and then placed into jars connected to the lyo manifold and under vacuum (e.g., 1-100 milli-Torr, or less) for about 12-48 hours. The lyophilized composition can be used to produce a capsule or a tablet formulation. In some embodiments, greater than 80%, greater than 85%, or greater than 90% of the IL-10 in the lyophilized composition is in a dimer form.

A formulation comprising IL-10 can be delivered to the small intestines or colon in a formulation described herein. The formulation can be delivered orally or rectally. In some embodiments, such formulations may facilitate crossing of the construct across the intestinal epithelial cell barrier (e.g., via transcytosis), which can otherwise prevent achievement of the full therapeutic potential of the IL-10. Furthermore, targeted delivery of IL-10 directly to gastrointestinal tissue via the oral route may bypass the side effects experienced with systemic administration and can translate into higher mucosal concentrations and clinically meaningful reductions in inflammation and disease.

Coated Oral Formulations for Targeted Release in the GI Tract

Contemplated herein are oral formulations comprising a therapeutic payload and one or more excipients providing an improved release profile that allows for a selective delivery of any payload to a certain region within the gastrointestinal (GI) tract of a subject. Preferably, the oral formulations are configured for site site-specific release of the therapeutic payload in the terminal ileum, proximal colon, or distal colon. EXAMPLE 13 describes coated oral formulations configured for site-specific release in the GI tract.

Payloads contemplated herein can be of any nature, including therapeutic, diagnostic, and imaging. A payload can be part of a delivery construct. A delivery construct can include a carrier coupled to a heterologous payload. The payload can be directly or indirectly, covalently or non-covalently, coupled to the carrier. When covalently attached, a payload can be directly attached to a carrier or via a spacer. While in one embodiment the payload is a therapeutic protein such as IL-10 or an IL-10 delivery construct (such as IL-10 delivery constructs described herein), the disclosure herein is not limited to any therapeutic protein, carrier, or payload.

The oral formulation for delivery of a payload, such as a therapeutic protein, to the lower GI tract can comprise a capsule or tablet with a coating configured to dissolve at a pH found in the small intestines or colon, which has a pH in the range of from about 5.5 to about 8.0. In some embodiments, the coating is configured not to dissolve in the highly acidic pH of the stomach, which can range from a pH of about 1.5 to about 3.5.

An oral formulation herein can be configured to pass through the stomach without releasing the payload to an appreciable extent. Release of the payload can occur after full or partial dissolution of at least one coating on a capsule or tablet comprising the payload. Release of the payload can occur after damage to a capsule or tablet, including microscopic damage such that the capsule or tablet can appear intact. In some embodiments, the oral formulation is configured to release less than about 5%, less than about 4%, less than about 3%, less than about 2%, less than about 1%, or 0% of the payload in the stomach. In some embodiments, the oral formulation is configured to release the payload in specific regions within the small intestine or the colon, such as the terminal ileum, proximal colon, and distal colon. The terminal ileum, or the distal end of the small intestines, intersects with the colon, and inflammation at this location can often be associated with GI disorders such as Crohn's disease. Site-specific release of therapeutic payloads with anti-inflammatory properties in the terminal ileum can therefore be desirable as a way to treat such disorders. The oral formulation can be configured to release from about 20% to 100% of the therapeutic payload upon exposure to a solution at a pH from about 6.5 to about 7.0 for from 2 to 8 hours. The solution can be citrate/phosphate buffer at the appropriate pH. The solution can be a digestive fluid. The digestive fluid can be stomach acid, intestinal juice (*Succus entericus*), or a combination thereof. The digestive fluid can comprise digestive enzymes. The digestive fluid can be found in the stomach, small intestine, colon, or a combination thereof.

In some embodiments, the oral formulation is configured to release from 80% to 100% of the therapeutic payload upon exposure to a solution at a pH from about 6.9 to about 7.1, preferably a pH of 7.0, for from 2 to 8 hours. The oral formulation can be configured to release from 75% to 100%, from 75% to 85%, or from 85% to 95% of the therapeutic payload upon exposure to a solution at a pH from about 6.9 to about 7.1, preferably a pH of 7.0, for 2 hours. The oral formulation can be configured to release at least 80%, 85%, 90%, or 95% of the therapeutic payload upon exposure to a solution at a pH from about 6.9 to about 7.1, preferably a pH of 7.0, for 2 hours. In some cases, the exposure to the solution may be conducted at 37° C.

In some embodiments, the oral formulation is configured to release from 80% to 100% of the IL-10 upon exposure to a solution at a pH from about 6.9 to about 7.1, preferably a pH of 7.0, for from 2 to 8 hours. The oral formulation can be configured to release from 75% to 100%, from 75% to 85%, or from 85% to 95% of the IL-10 upon exposure to a solution at a pH from about 6.9 to about 7.1, preferably a pH of 7.0, for 2 hours. The oral formulation can be configured to release at least 80%, 85%, 90%, or 95% of the IL-10 upon exposure to a solution at a pH from about 6.9 to about 7.1, preferably a pH of 7.0, for 2 hours. In some cases, the exposure to the solution may be conducted at 37° C.

In some embodiments, the oral formulation is configured to release from 50% to 100% of the therapeutic payload upon exposure to a solution at a pH from about 6.4 to about 6.6, preferably a pH of 6.5, for about 2 to 8 hours. The oral formulation can be configured to release from 50% to 95%, from 60% to 70%, or from 75% to 90% of the therapeutic payload upon exposure to a solution at a pH from about 6.4 to about 6.6, preferably a pH of 6.5, for 2 or 3 hours. The oral formulation can be configured to release at least 60%, 65%, 70%, 75%, 80%, 85%, or 90% of the therapeutic payload upon exposure to a solution at a pH from about 6.4 to about 6.6, preferably a pH of 6.5, for 2 or 3 hours. In some cases, the exposure to the solution may be conducted at 37° C.

In some embodiments, the oral formulation is configured to release from 50% to 100% of the IL-10 upon exposure to a solution at a pH from about 6.4 to about 6.6, preferably a pH of 6.5, for about 2 to 8 hours. The oral formulation can be configured to release from 50% to 95%, from 60% to 70%, or from 75% to 90% of the IL-10 upon exposure to a solution at a pH from about 6.4 to about 6.6, preferably a pH of 6.5, for 2 or 3 hours. The oral formulation can be configured to release at least 60%, 65%, 70%, 75%, 80%, 85%, or 90% of the IL-10 upon exposure to a solution at a pH from about 6.4 to about 6.6, preferably a pH of 6.5, for 2 or 3 hours. In some cases, the exposure to the solution may be conducted at 37° C.

In some embodiments, the oral formulation is configured to release from 20% to 100% of the therapeutic payload upon exposure to a solution at a pH from about 5.9 to about 6.1, preferably a pH of 6.0, for about 2 to 8 hours. The oral formulation can be configured to release from 20% to 80%, or from 20% to 30%, of the therapeutic payload upon exposure to a solution at a pH from about 5.9 to about 6.1, preferably a pH of 6.0, for 2 or 3 hours. The oral formulation can be configured to release at least 20%, 25%, 30%, 40%, 50%, 60%, 70%, 80%, 90%, or 95% of the therapeutic payload upon exposure to a solution at a pH from about 5.9 to about 6.1, preferably a pH of 6.0, for 2 or 3 hours. In some cases, the exposure to the solution may be conducted at 37° C.

In some embodiments, the oral formulation is configured to release from 20% to 100% of the IL-10 upon exposure to a solution at a pH from about 5.9 to about 6.1, preferably a pH of 6.0, for about 2 to 8 hours. The oral formulation can be configured to release from 20% to 80%, or from 20% to 30%, of the IL-10 upon exposure to a solution at a pH from about 5.9 to about 6.1, preferably a pH of 6.0, for 2 or 3 hours. The oral formulation can be configured to release at least 20%, 25%, 30%, 40%, 50%, 60%, 70%, 80%, 90%, or 95% of the IL-10 upon exposure to a solution at a pH from about 5.9 to about 6.1, preferably a pH of 6.0, for 2 or 3 hours. In some cases, the exposure to the solution may be conducted at 37° C.

The oral formulation can be a solid. The oral formulation can comprise a lyophilized composition or a spray dried composition. The lyophilized composition or a spray dried composition can comprise the therapeutic protein and the one or more excipients. The lyophilized composition or a spray dried composition can be a powder. The lyophilized composition or a spray dried composition can comprise microparticles. The microparticles can have a diameter of about 1 μm to about 500 μm, about 5 μm to about 250 μm, about 5 μm to about 100 μm, about 5 μm to about 50 μm, or about 5 μm to about 15 μm. The lyophilized composition or a spray dried composition can comprise granules. The solid oral formulation can be a capsule. The capsule can encapsulate the lyophilized composition. The solid oral formulation can be a tablet. The oral formulation can be in a unit dose form.

The oral formulation can comprise from about 1 mg to about 5 mg, from about 1 mg to about 10 mg, from about 1 mg to about 20 mg, from about 20 mg to about 50 mg, from about 20 mg to about 100 mg, or from about 50 mg to about 100 mg of the therapeutic protein. The oral formulation can comprise about 1 mg, 5 mg, or 20 mg of therapeutic protein. In some embodiments, from about 32% to about 42% (w/w) of the lyophilized composition is the therapeutic protein.

The one or more excipients can comprise, consist essentially of, or consist of a surfactant, an osmolyte, a bulking agent, a salt, or a combination thereof. The one or more excipients can comprise, consist essentially of, or consist of potassium phosphate, glycine, sucrose, and poloxamer 188. The one or more excipients can further comprise a compacting excipient.

In some embodiments, the one or more excipients can be an osmolyte. Osmolytes can be used in pharmaceutical formulations comprising proteins to improve stability of the proteins and decrease protein aggregation. The osmolyte can be an amino acid (e.g. proline or glycine), a methyl-amine (e.g., betaine or trimethylamine-N-oxide), or a polyol or sugar (e.g. sorbitol or sucrose). The osmolyte can be sucrose, trehalose, glycine, mannitol, histidine, dextose/dextran, arginine, maltose, sorbitol, taurine, glycine betaine, sarcosine, raffinose, glycerol, proline, fructan, L-glutamate, lactose, or a combination thereof. The osmolyte can be sucrose. The oral formulation can comprise a weight ratio of the osmolyte to therapeutic protein from about 0.3:1 to about 0.7:1, from about 0.4:1 to about 0.6:1, from about 0.45:1 to about 0.55:1, from about 0.49:1 to about 0.51:1, or more preferably about 0.5:1. In some embodiments, from about 15% to about 21% (w/w) of the lyophilized composition is the osmolyte.

In some embodiments, the one or more excipients can include a surfactant. Surfactants can be used in solid oral formulations comprising proteins, such as a capsule or tablet, to enhance disintegration of the solid oral formulation and increase solubility of the proteins. The surfactant can be polysorbate 80, polysorbate 20, poloxamer 188, or a combination thereof. The oral formulation can comprise a weight ratio of the surfactant to therapeutic protein from about 0.1:1 to about 0.19:1, from about 0.12:1 to about 0.18:1, from about 0.14:1 to about 0.16:1, or more preferably about 0.15:1. In some embodiments, from about 4.5% to about 6.5% (w/w) of the lyophilized composition is the surfactant. The surfactant can be a non-ionic copolymer. The non-ionic copolymer can comprise a central polyoxypropylene chain flanked by two polyoxyethylene chains. The non-ionic copolymer can be a poloxamer. Use of a poloxamer as an excipient in the compositions described herein can promote or maintain dimerization of the IL-10 or IL-10 delivery construct relative to the use of other surfactants, such as a polysorbate.

The poloxamer can comprise a molecular mass of polyoxypropylene from 1600 g/mol to 2000 g/mol. The poloxamer can comprise from 70% to 90% polyoxyethylene. The poloxamer can be poloxamer 188. In some embodiments, the surfactant is not a polysorbate, such as polysorbate 80 (e.g. Tween 80) or polysorbate 20 (e.g. Tween 20). An IL-10 delivery construct composition comprising a poloxamer as an excipient can have a greater amount of IL-10 in a dimer form relative to an IL-10 delivery construct composition comprising a polysorbate as an excipient. An IL-10 delivery construct composition comprising a poloxamer as an excipient can have a decreased amount of IL-10 in an aggregate or monomer form relative to an IL-10 delivery construct composition comprising a polysorbate as an excipient.

The one or more excipients can include a salt. The salt can be potassium phosphate, sodium chloride, potassium chloride, magnesium chloride, sodium sulfate, or a combination thereof. The salt can be potassium phosphate. The oral formulation can have a weight ratio of the salt to therapeutic protein from about 0.03:1 to about 0.1:1, from about 0.05:1 to about 0.09:1, from about 0.06:1 to about 0.08:1, or more preferably about 0.07:1. In some embodiments, from about 2% to about 3% (w/w) of the lyophilized composition is the salt.

The one or more excipients can include sodium hydroxide. The oral formulation can have a weight ratio of the sodium hydroxide to therapeutic protein from about 0.03:1 to about 0.1:1, from about 0.05:1 to about 0.09:1, from about 0.06:1 to about 0.08:1, or more preferably about 0.07:1. In some embodiments, from about 2% to about 3% (w/w) of the lyophilized composition is sodium hydroxide.

In some embodiments, the one or more excipients can include a bulking agent. Bulking agents can be used to increase the size of an oral formulation for ease of manufacturing. The bulking agent can be starch, lactose, dextrin, glucose, sucrose, sorbitol, raffinose, trehalose, glycine, mannitol, or a combination thereof. The bulking agent can be glycine. The oral formulation can comprise a weight ratio of the bulking agent to therapeutic protein from about 0.7:1 to about 1.3:1, from about 0.8:1 to about 1.2:1, from about 0.9:1 to about 1.1:1, or more preferably about 1:1. In some embodiments, from about 32% to about 42% (w/w) of the lyophilized composition is the bulking agent. In some embodiments, the buffering agent is an osmolyte.

The lyophilized composition can be stored from about 2° C. to about 8° C. The lyophilized composition can be stored from about −15° C. to about −25° C. The lyophilized composition can be stable from about 2° C. to about 8° C. with ambient relative humidity for at least 12 months. In some embodiments, when the therapeutic protein is in a dimer form, the lyophilized composition is stable if there is no more than a 1%, 2%, 3%, 4%, 5%, 10%, 20%, or 25% decrease in the amount of therapeutic protein dimers after one year of storage at from about 2° C. to about 8° C. In some embodiments, when the therapeutic protein is in a dimer form, the lyophilized composition is stable if there is no more than a 1%, 2%, 3%, 4%, 5%, 10%, 20%, or 25% decrease in the amount of therapeutic protein dimers after one year of storage at from about −15° C. to about −25° C. In some embodiments, the lyophilized composition is compacted into a tablet or filled in a capsule to produce the oral formulation described herein.

Further described herein, in certain embodiments, are liquid compositions comprising the therapeutic protein and the one or more excipients which can be lyophilized to produce the lyophilized composition described herein. The therapeutic protein can be an IL-10 delivery construct as described herein. The liquid composition can comprise a lyophilization buffer and the IL-10 delivery construct. The liquid composition can comprise from 15 mg/mL to 25 mg/mL of the IL-10 delivery construct, preferably about 20 mg/mL. The liquid composition can comprise from 1.51 mg/mL to 1.91 mg/mL of potassium phosphate, preferably about 1.71 mg/mL. The liquid composition can comprise from 15 mg/mL to 25 mg/mL of glycine, preferably about 20 mg/mL. The liquid composition can comprise from 8 mg/mL to 12 mg/mL of sucrose, preferably about 10 mg/mL. The liquid composition can comprise from 2.5 mg/mL to 3.5 mg/mL of Poloxamer 188, preferably about 3 mg/mL. The liquid composition can have a pH from about 5.0 to about pH 8.0, from about 6.0 to about 7.5, or from about 6.5 to about 7.5. The liquid composition can have a pH of from about 7.4 to about 7.6.

The liquid composition can be stable from about −80° C. to about −60° C. with ambient relative humidity for at least 12 months. In some embodiments, there is no more than a 2% decrease in percentage of the therapeutic protein in the dimer form of the liquid composition after 7 days at 4° C. The liquid composition can be frozen to produce a frozen therapeutic protein composition. The liquid composition can be frozen at a temperature from about −85° C. to about −15° C. In some embodiments, the frozen therapeutic protein composition is thawed prior to lyophilization.

In some embodiments, lyophilized composition is encapsulated in a capsule. The capsule can be a size 000, 00, 0, 1, 2, 3, 4, or 5 capsule. The capsule can be a two-piece capsule. The capsule can be a hydroxypropyl methylcellulose (HPMC) capsule, also referred to as a Hypromellose capsule.

Alternatively, lyophilized composition can be compressed under a compression force to produce a tablet. The compression force can range from 1500 pound-force (lbf) to 4000 lbf or from 2000 lbf to 3500 lbf. The compression force can be 1500 lbf, 2000 lbf, 2500 lbf, 3000 lbf, 3500 lbf, or 4000 lbf. The tablet can have a weight from 150 mg to 1000 mg, from 150 mg to 500 mg, from 200 mg to 400 mg, from 150 mg to 250 mg, from 175 mg to 225 mg, or from 190 mg to 210 mg. The tablet can comprise a diameter from 0.2" to 0.4", from 0.25" to 0.35", or from 0.3" to 0.25". The tablet can comprise from 1 mg to 5 mg, from 1 mg to 10 mg, from 1 mg to 20 mg, from 20 mg to 50 mg, from 20 mg to 100 mg, or from 50 mg to 100 mg of the IL-10 delivery construct. The tablet can comprise about 1 mg, about 5 mg, about 10 mg, about 20 mg, or about 30 mg of the IL-10 delivery construct. The tablet can comprise from 4.5 mg to 5.5 mg, from 9.5 mg to 10.5 mg, from 19 mg to 21 mg, or from 29 mg to 31 mg of an IL-10 or IL-10 delivery construct. The tablet can comprise from 3 mg to 9 mg, from 4 mg to 8 mg, or from 5 mg to 7 mg strength of an IL-10 or IL-10 delivery construct. The tablet can be round, oblong, oval, circular, or any other suitable shape.

When the oral formulation is a tablet, the one or more excipients can include a compacting excipient. The one or more excipients can comprise 1, 2, 3, 4, or more than 4 compacting excipients. The compacting excipient can be a disintegrant, a binding agent, a lubricant, or a combination thereof. The oral formulation can comprise a weight ratio of the lyophilized composition previously described to the compacting excipient of from about 0.8:3 to about 1.2:3, from about 0.9:3 to about 1.1:3, from about 0.95:3 to about 1.05:3, or more preferably about 1:3. The IL-10 delivery construct can comprise from about 5% to about 15% (w/w) of the tablet. In some embodiments, the compacting excipient is not part of the liquid composition. In some embodiments, the lyophilized composition does not include the compacting excipient.

The compacting excipients can comprise a disintegrant. A disintegrant can facilitate the dispersion or break up of an oral formulation. The disintegrant can comprise microcrystalline cellulose (MCC), silicified microcrystalline cellulose (SMCC), starch, sodium starch glycolate, veegum, bentonite, alginic acid, calcium alginate, croscarmellose sodium (crosslinked sodium carboxymethyl cellulose), crospovidone (crosslinked polyvinylpyrrolidone), or a combination thereof.

The compacting excipients can comprise a binding agent. A binding agent can hold the components of an oral formulation together. The binding agent can comprise a disaccharide, a polysaccharide, a protein, or a polymer. The disaccharide can be sucrose or lactose. The lactose can be lactose monohydrate. The polysaccharide can be starch, cellulose, or a derivative thereof. The protein can be gelatin. The polymer can be polyvinylpyrrolidone (PVP) or polyethylene glycol (PEG).

The compacting excipients can be a lubricant. A lubricant can reduce interparticle friction and cohesion in an oral formulation. The lubricant can comprise magnesium stearate, glyceryl behenate, glyceryl dibehenate, sodium stearyl fumarate, stearic acid, talc, silica, calcium stearate, magnesium carbonate, hydrogenated oil, mineral oil, polyethylene glycol (PEG), glyceryl monostearate or a combination thereof. The lubricant can be a non-ionic surfactant. The non-ionic surfactant can be glyceryl behenate. The glyceryl behenate be glyceryl dibehenate. In some embodiments, the lubricant is not an ionic surfactant, such as magnesium stearate, sodium stearyl fumarate, and sodium laurisulfate. In some embodiments, the use of a non-ionic surfactant, such as glyceryl behenate or glyceryl dibehenate, in the generation of a tablet results in an improved dissolution profile of the tablet relative to if an ionic surfactant, such as magnesium stearate, sodium stearyl fumarate, or sodium laurisulfate, is used in the generation of the tablet. Stated differently, the use of a non-ionic surfactant, such as glyceryl behenate or glyceryl dibehenate, may result in a formulation in which a higher concentration of the IL-10 delivery construct remains in dimer form for a longer period of time relative to a corresponding formulation that uses an ionic surfactant, such as magnesium stearate, sodium stearyl fumarate, or sodium laurisulfate.

In some embodiments, the one or more compacting excipients are combined with the lyophilized composition previously described prior to compacting into a tablet or filling a capsule. In some embodiments, a composition for compacting can comprise from about 6% to about 10% (w/w) of the lyophilized composition and from about 90% to about 94% (w/w) of the one or more compacting excipients. In some embodiments, a composition for compacting can comprise from about 5% to about 15% (w/w) of the lyophilized composition and from about 85% to about 95% (w/w) of the one or more compacting excipients. The one or more contacting excipients can comprise at least two disintegrants.

In some embodiments, granules are formed during the process of making an oral formulation. For instance, in some cases, there are two phases to production of tablets using a granulation process: an intragranular (IG) phase and an extragranular (EG) phase. In the intragranular phase, the lyophilized composition and a first subset of the one or more compacting excipients can be blended and granulated with a binder to produce a blended composition which can then be compressed (e.g by roller compaction) and milled into granules. In the extragranular phase, the dry granules can then be blended with a second subset of the one or more compacting excipients and compressed into an oral formulation, such as a tablet.

The granules produced in the intragranular phase can comprise a weight ratio of the first subset of the one or more compacting excipients to the lyophilized powder comprising the IL-10 delivery construct of from about 7:1 to about 11:1, from about 8:1 to about 10:1, or from about 8.5:1 to about 9.5:1. In some embodiments, the first subset of the one or more compacting excipients can comprise at least two disintegrants. In some embodiments, the first subset of the one or more compacting excipients can comprise a weight ratio of a first disintegrant to a second disintegrant of from about 21:1 to about 24:1, from about 22:1 to about 23.5:1, or from about 22.3:1 to about 23:1. The first disintegrant can be silicified microcrystalline cellulose (SMCC) or dicalcium phosphate/microcrystalline cellulose (DCP/MCC). The second disintegrant can comprise crospovidone or croscarmellose sodium. In some embodiments, the first subset of the one or more compacting excipients comprises a lubricant. The weight ratio of the at least two disintegrants to the lubricant in the first subset of the one or more excipients can be from about 61:1 to about 81:1, from about 66:1 to about 76:1, or from about 71:1 to about 73:1. The lubricant can comprise glyceryl dibehenate. The lubricant can comprise glyceryl behenate.

The extragranular phase can comprise a weight ratio of the granules produced in the intragranular phase to the second subset of the one or more compacting excipients from about 2:1 to about 6:1, from about 3:1 to about 5:1, or from about 3.5:1 to about 4.5:1. In some embodiments, the second subset of the one or more compacting excipients can comprise at least two disintegrants. In some embodiments, the second subset of the one or more compacting excipients can comprise a weight ratio of a first disintegrant to a second disintegrant of from about 13.5:1 to about 24:1, from about 16:1 to about 21.5:1, or from about 17.5:1 to about 19:1. The first disintegrant can be SMCC or DCP/MCC. The second disintegrant can comprise crospovidone or croscarmellose sodium. In some embodiments, the second subset of the one or more compacting excipients comprises a lubricant. The weight ratio of the at least two disintegrants to the lubricant to in the second subset of the one or more excipients can be from about 69:1 to about 89:1, from about 74:1 to about 84:1, or from about 77:1 to about 81:1. The lubricant can comprise glyceryl behenate. The glyceryl behenate can comprise glyceryl dibehenate. In some embodiments, the compacting excipients can comprise, consist essentially of, or consist of SMCC, crospovidone, and glyceryl behenate.

In some embodiments, the oral formulation can comprise a weight ratio of the one or more compacting excipients to the lyophilized composition of from about 9:1 to about 14:1, from about 10:1 to about 13:1, or from about 11:1 to about 12:1. In some embodiments, the oral formulation can comprise a weight ratio of a first disintegrant of the one or more compacting excipients to the lyophilized composition of from about 8.8:1 to about 12.8:1, from about 9.8:1 to about 11.8:1, or from about 10.4:1 to about 11.2:1. In some embodiments, the oral formulation can comprise a weight ratio of the lyophilized composition to a second disintegrant of the one or more compacting excipients of from about 1.5:1 to about 2.5:1, from about 1.75:1 to about 2.25:1, or from about 1.9:1 to about 2.1:1.

In some embodiments, the oral formulation can comprise a weight ratio of the lyophilized composition to a lubricant of the one or more compacting excipients of from about 5:1 to about 8.1:1, from about 5.5:1 to about 8.1:1, or from about 6.2:1 to about 6.6:1.

The oral formulation can comprise a first coat comprising a first copolymer, a second copolymer, or a mixture of the first copolymer and the second copolymer. The oral formulation can comprise a first coat of Hypromellose acetate succinate (HPMCAS or HPMC-AS). The first coat can have a thickness substantially equivalent to from 20 mg to 200 mg, from 20 mg to 40 mg, from 50 mg to 70 mg, from 115 mg to 135 mg, or from 175 mg to 185 mg of the first coat on a size 1 capsule. The first coat can have a thickness substantially equivalent to from 55 mg to 65 mg of the first coat on a size 1 capsule. The first coat can have a thickness substantially equivalent to from 20 mg to 200 mg, from 20 mg to 40 mg, from 50 mg to 80 mg, from 115 mg to 135 mg, or from 175 mg to 185 mg of the first coat on a size 0 capsule. The first coat can have a thickness substantially equivalent to from 70 mg to 80 mg of the first coat on a size 0 capsule. The first coat can have a mass from 20 mg to 200 mg, from 20 mg to 40 mg, from 50 mg to 80 mg, from 115 mg to 135 mg, or from 175 mg to 185 mg.

The surface area for a size 1 capsule can be approximately 410 $mm^2$. The surface area for a size 0 capsule can be approximately 500 $mm^2$. A coat thickness of 0.15 $mg/mm^2$ can be equivalent to a 60 mg coat weight on a size 1 capsule or 75 mg coat weight on a size 0 capsule. In some embodiments, the capsule has a coat thickness of from 0.1 mg/mm2 to 0.2 $mg/mm^2$, preferably 0.15 $mg/mm^2$. In some embodiments, the coat thickness on a capsule can be from 4 $mg/cm^2$ to 20 $mg/cm^2$, from 4 $mg/cm^2$ to 6 $mg/cm^2$, from 5 $mg/cm^2$ to 10 $mg/cm^2$, or from 5 $mg/cm^2$ to 20 $mg/cm^2$. The coat thickness can be a thickness of the first coat.

In some embodiments, the tablet has a coat thickness of from 0.1 $mg/mm^2$ to 0.2 $mg/mm^2$, from 0.1 $mg/mm^2$ to 0.5 $mg/mm^2$, or from 0.1 $mg/mm^2$ to 1.0 $mg/mm^2$ preferably 0.15 $mg/mm^2$. In some embodiments, the coat thickness on a tablet can be from 4 $mg/cm^2$ to 20 $mg/cm^2$, from 4 $mg/cm^2$ to 6 $mg/cm^2$, from 5 $mg/cm^2$ to 10 $mg/cm^2$, or from 5 $mg/cm^2$ to 20 $mg/cm^2$. The coat thickness can be a thickness of the first coat.

The first copolymer can have an individual nominal dissolution of pH>5.5. The nominal dissolution pH indicates the pH at which the copolymer becomes soluble. The first copolymer can comprise methacrylic acid and ethyl acrylate. The first polymer can have a weight average molecular mass from 200,000 g/mol to 450,000 g/mol, or from 250,000 g/mol to 400,000 g/mol, or from 280,000 g/mol to 370,000 g/mol, or from 300,000 g/mol to 340,000 g/mol. The first polymer can comprise a ratio of free carboxyl groups to ester groups in the first copolymer is from 0.8:1 and 1.2 to 1. The first copolymer can comprise a polymer of formula I, wherein x, y, and n are each greater than or equal to one. The first copolymer can comprise Eudragit® L 30 D-55.

Formula I

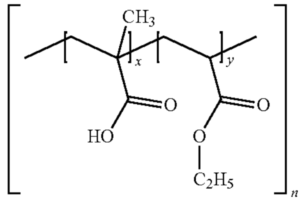

The second copolymer can have a nominal dissolution at pH>7.0. The second copolymer can comprise methacrylic acid, methyl methacrylate, and methyl acrylate. The second polymer can have a weight average molecular mass from 160,000 g/mol to 400,000 g/mol or from 200,000 g/mol to 360,000 g/mol, or from 240,000 g/mol to 320,000 g/mol, or from 260,000 g/mol to 300,000 g/mol. The second polymer can comprise a ratio of free carboxyl groups to ester groups in the second copolymer is from 0.8:1 and 1.2 to 1. The second polymer can comprise a polymer of formula II, wherein x, y, z, and n are each greater than or equal to one. The second copolymer can comprise Eudragit® FS 30 D.

Formula II

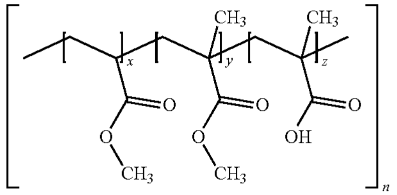

The second copolymer can be different from the first copolymer. The nominal dissolution pH of a mixture of the first copolymer and the second copolymer can be different from the nominal dissolution pH of the first copolymer or second copolymer individually. For example, the nominal dissolution pH of a mixture of the first copolymer and the second copolymer can be a nominal dissolution between the nominal dissolutions of the first copolymer and the second copolymer. The first coat can comprise an equal amount of the second copolymer relative to an amount of the first copolymer. The first coat can comprise a greater amount of the second copolymer relative to an amount of the first copolymer. A weight ratio of the first copolymer to the second copolymer can be about or between any of 50:50, 45:55, 40:60, 35:65, 30:70, 25:75, 20:80, 15:85, 10:90, 5:95, or 0:100. A weight ratio of Eudragit® L30D55:Eudragit® FS30D can be about 50:50, 45:55, 40:60, 35:65, 30:70, 25:75, 20:80, 15:85, 10:90, 5:95, or 0:100.

A weight ratio of the first copolymer to the second copolymer in the first coat can be from 0:100 to 100:0. The weight ratio of the first copolymer to the second copolymer in the first coat can be from 45:55 to 55:45, from 25:75 to 35:65, from 15:85 to 25:75, or from 15:85 to 0:100.

In some embodiments, a weight ratio of the first copolymer to the second copolymer in the first coat of from 45:55 to 55:45 with an equivalent coating thickness from 40 mg to 70 mg on a size 1 capsule results in release of the therapeutic payload in the terminal ileum. In some embodiments, a weight ratio of the first copolymer to the second copolymer of 50:50 with a coating thickness of about 0.15 $mg/mm^2$ results in release of the therapeutic payload in the terminal ileum.

In some embodiments, a weight ratio of the first copolymer to the second copolymer in the first coat of from 15:85 to 25:75 with an equivalent coating thickness from about 118 mg to 138 mg on a size 1 capsule results in release of the therapeutic payload in the distal colon.

In some embodiments, a weight ratio of the first copolymer to the second copolymer in the first coat of from 15:85 to 25:75 with an equivalent coating thickness from 40 mg to 70 mg on a size 1 capsule results in release of the therapeutic payload in the proximal colon. In some embodiments, a weight ratio of the first copolymer to the second copolymer of 20:80 with a coating thickness of about 0.15 $mg/mm^2$ results in release of the therapeutic payload in the proximal colon.

The first coat can further comprise an anti-tacking agent, a plasticizer, a surfactant, or a combination thereof. The anti-tacking agent can be glycerol monostearate. The plasticizer can be triethyl citrate. The surfactant can be polysorbate 80.

In some embodiments, from 5% to 15% (w/w) of the first coat is a mixture of the anti-tacking agent, the plasticizer, and the surfactant. In some embodiments, from 40% to 50% (w/w) of the first coat is the first copolymer. In some embodiments, from 40% to 50% (w/w) of the first coat is the second copolymer. In some embodiments, the weight ratio of the first copolymer and second copolymer to the mixture of the anti-tacking agent, the plasticizer, and the surfactant is from 8:1 to 10:1, from 8.5:1 to 9.5:1, or from 8.8:1 to 9.2:1.

In some embodiments, from 5% to 15% (w/w) of the first coat is a mixture of glycerol monostearate, triethyl citrate, and polysorbate 80. In some embodiments, from 40% to 50% (w/w) of the first coat is a first copolymer comprising methacrylic acid and ethyl acrylate. In some embodiments, from 40% to 50% (w/w) of the first coat is a second copolymer comprising methacrylic acid, methyl methacrylate, and methyl acrylate.

As previously described, the oral formulation can comprise a first coat of Hypromellose acetate succinate (HPMCAS or HPMC-AS). The first coat of HPMCAS can comprise a mixture of a first HPMCAS and a second HPMCAS. The first HPMCAS can become soluble at a pH of greater than or equal to 6.8. The second HPMCAS can become soluble at a pH of greater than or equal to 6.0. The first HPMCAS can comprise HPMCAS-HF. The second HPMCAS can comprise HPMCAS-MF. The ratio of the first HPMCAS to the second HPMCAS can be from about 40:60 to about 60:40 or from about 45:55 to about 55:45.

Figure 31B:
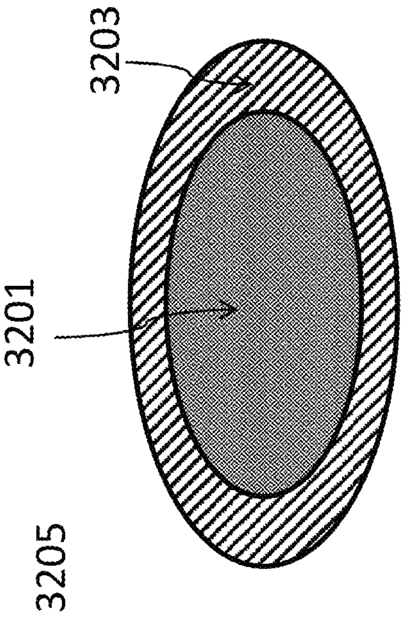
FIGS. 31A-31B illustrate embodiments of oral formulations 3200 and 3205 described herein.
Figure 31A:
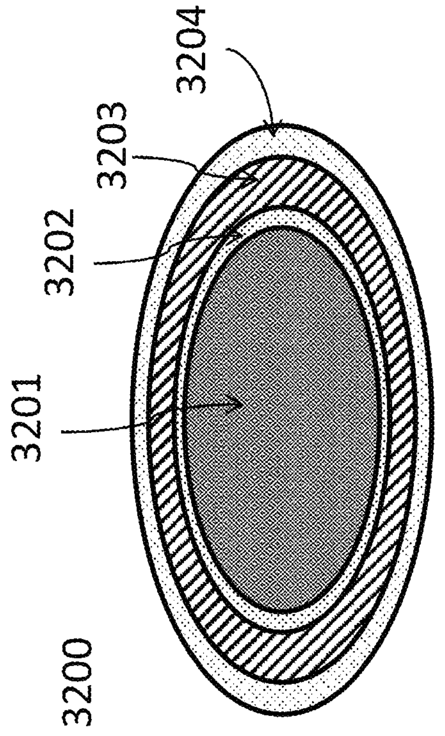

In some embodiments, the oral formulation can be an oral formulation as represented by FIG. 31A. The oral formulation 3200 can comprise a capsule or a tablet, wherein the capsule or tablet comprises an interior region 3201 comprising the therapeutic protein and the one or more excipients. The oral formulation 3200 can comprise a first coat 3203. The first coat 3203 can comprise a mixture of the first copolymer and the second copolymer. The first coat 3203 can further comprise an anti-tacking agent, a plasticizer, and a surfactant. The oral formulation 3200 can further comprise a second coat 3202. The second coat 3202 can comprise hydroxypropyl methylcellulose (HPMC). The second coat can seal a seam of the capsule. In some embodiments, the capsule is a hydroxypropyl methylcellulose (HPMC) capsule. The oral formulation 3200 can comprise a third coat 3204. The third coat 3204 can comprise HPMC. In some embodiments, the first coat 3203, the second coat 3202, the third coat, or the combination thereof are applied to the capsule or tablet by spray-coating. In some embodiments, a solution of HPMC with an HPMC concentration of from 6.5% to 8.5% (w/w) is spray coated onto the capsule or tablet to apply the second coat 3202, third coat, or both the second coat 3202 and third coat. In some embodiments, the second coat 3202 comprises from 9 mg to 13 mg, from 10 mg to 12 mg, or from 10.5 mg to 11.5 mg of HPMC on a size 0 capsule. Equivalent coat weights of the second coat 3202 can be applied to other capsule sizes. In some embodiments, the third coat 3204 comprises from 9 mg to 13 mg, from 10 mg to 12 mg, or from 10.5 mg to 11.5 mg of HPMC on a size 0 capsule. Equivalent coat weights of the third coat 3204 can be applied to other capsule sizes.

In some embodiments, the oral formulation can be an oral formulation as represented by FIG. 31B. The oral formulation 3205 can comprise a capsule or a tablet, wherein the capsule or tablet comprises an interior region 3201 comprising the therapeutic protein and the one or more excipients. The oral formulation 3200 can comprise a first coat 3203. The first coat 3203 can comprise a mixture of the first copolymer and the second copolymer. The first coat 3203 can further comprise an anti-tacking agent, a plasticizer, and a surfactant. In some embodiments, the oral formulation 3205 does not comprise a second coat or a third coat.

The oral formulation can have a shelf life of at least 3 months, at least 6 months, at least 12 months, at least 18 months, or at least 24 months. Shelf life may be assessed by storing a tablet for the indicated time period, removing the coating from the tablet, dissolving the inner core of the tablet and assessing the dimer percentage as described herein.

The oral formulation can be configured to release from about 20% to 100% of the IL-10 upon exposure to a solution at a pH from about 6.5 to about 7.0 for from 2 to 8 hours at 37° C. The solution can be citrate/phosphate buffer at the appropriate pH. The solution can be a digestive fluid. The digestive fluid can be stomach acid, intestinal juice (*Succus entericus*), or a combination thereof. The digestive fluid can comprise digestive enzymes. The digestive fluid can be found in the stomach, small intestine, colon, or a combination thereof. The IL-10 can be in the form of an IL-10 delivery construct.

In some embodiments, the oral formulation is configured to release from 80% to 100% of the IL-10 upon exposure to a solution at a pH from about 6.9 to about 7.1, preferably a pH of 7.0, for from 2 to 8 hours. The oral formulation can be configured to release from 75% to 100%, from 75% to 85%, or from 85% to 95% of the IL-10 upon exposure to a solution at a pH from about 6.9 to about 7.1, preferably a pH of 7.0, for 2 hours. The oral formulation can be configured to release at least 80%, 85%, 90%, or 95% of the IL-10 upon exposure to a solution at a pH from about 6.9 to about 7.1, preferably a pH of 7.0, for 2 hours.

In some embodiments, the oral formulation is configured to release from 50% to 100% of the IL-10 upon exposure to a solution at a pH from about 6.4 to about 6.6, preferably a pH of 6.5, for about 2 to 8 hours. The oral formulation can be configured to release from 50% to 95%, from 60% to 70%, or from 75% to 90% of the IL-10 upon exposure to a solution at a pH from about 6.4 to about 6.6, preferably a pH of 6.5, for 2 or 3 hours. The oral formulation can be configured to release at least 60%, 65%, 70%, 75%, 80%, 85%, or 90% of the IL-10 upon exposure to a solution at a pH from about 6.4 to about 6.6, preferably a pH of 6.5, for 2 or 3 hours.

In some embodiments, the oral formulation is configured to release from 20% to 100% of the IL-10 upon exposure to a solution at a pH from about 5.9 to about 6.1, preferably a pH of 6.0, for about 2 to 8 hours. The oral formulation can be configured to release from 20% to 80%, or from 20% to 30%, of the IL-10 upon exposure to a solution at a pH from about 5.9 to about 6.1, preferably a pH of 6.0, for 2 or 3 hours. The oral formulation can be configured to release at least 20%, 25%, 30%, 40%, 50%, 60%, 70%, 80%, 90%, or 95% of the IL-10 upon exposure to a solution at a pH from about 5.9 to about 6.1, preferably a pH of 6.0, for 2 or 3 hours.

In some embodiments, the oral formulation is configured such that from 20% to 30% of the IL-10 released upon exposure to the solution at a pH of from about 6.5 to 7.0 for 2 hours is in a dimer form. In some embodiments, the oral formulation is configured such that at least 15%, 20%, 25%, or 30% of the IL-10 released upon exposure to the solution at a pH of from about 6.5 to 7.0 for 2 hours is in a dimer form. In some embodiments, the oral formulation is configured such that no more than 50%, 60%, 70%, 80%, or 90% of the IL-10 released upon exposure to the solution at a pH of from about 6.5 to 7.0 for 2 hours is in a dimer form. In some embodiments, following submersion of the oral formulation into a solution at pH 7.0, a percentage of IL-10 in the dimer form is at least 35%, 40%, 45%, or 50%.

The oral formulation comprising IL-10 delivery constructs can be formulated to have at least 15% of the IL-10 delivery constructs remain in the dimer form after a five-minute incubation with simulated intestinal fluid (SIF)/pancreatin. The pancreatin assay comprises incubating the oral formulation comprising the therapeutic protein with pancreatin (10 μg) in PBS (100 μL) at 37° C.

The oral formulation can comprise from 0.3 mg to 10 mg, from 0.3 mg to 5 mg, from 0.3 mg to 3 mg, from 1 mg to 3 mg, from 1 mg to 5 mg, from 1 mg to 10 mg, from 1 mg to 20 mg, from 20 mg to 50 mg, from 20 mg to 100 mg, or from 50 mg to 100 mg of the IL-10 delivery constructs. The oral formulation can comprise 0.3 mg, 1 mg, 2 mg, 3 mg, 4 mg, 5 mg, 6 mg, 7 mg, 8 mg, 9 mg, 10 mg, or 20 mg of the IL-10 delivery constructs.

The oral formulation comprising an IL-10 delivery construct can have a shelf life of at least 3 months, at least 6 months, at least 12 months, at least 18 months, or at least 24 months. The oral formulation comprising an IL-10 delivery construct can be stable at a specified temperature (e.g., 2-8° C. or room temperature) for a specified period of time (e.g., for at least 1 month, 3 months, at least 6 months, at least 12 months, at least 18 months, or at least 24 months). For instance, the oral formulation comprising an IL-10 delivery construct can have sufficient stability such that the percentage of IL-10 delivery constructs in a dimer form does not decrease by more than 1%, 2%, 3%, 4%, or 5% when stored at a specified temperature (e.g., 2-8° C. or room temperature) for a specified period of time (e.g., for at least 1 month, 3 months, at least 6 months, at least 12 months, at least 18 months, or at least 24 months). In some embodiments, the oral formulation is sufficiently stable such that the level of dimers of the IL-10 delivery construct in the oral formulation remains at greater than 80%, greater than 85%, or greater than 90% after the period of time has passed.

Described herein, in certain embodiments, are kits comprising at least one of a unit dosage form of the oral formulation described herein. The unit dosage forms can be presented in a pack, dispenser device, or bottle. The pack can comprise metal or plastic foil. An example of a pack can include, but is not limited to, a blister pack. The bottle can be a high-density polyethylene (HDPE) bottle. The bottle can further comprise an induction seal. The unit dosage forms can be packaged within the kit separately (e.g., in different units of a blister pack) or together (e.g., combined in a single container, such as a bottle). The kit can further comprise instructions for using the unit dosage forms for the treatment of a disorder causing inflammation. The kit can comprise a notice associated with the container in a form prescribed by a governmental agency regulating the manufacture, use, or sale of pharmaceuticals. The governmental agency can be the U.S. Food and Drug Administration. The notice can be an approved product insert.

Treatment

Described herein, in certain embodiments, are methods of treating a disease or condition in an individual in need thereof. The individual can be a mammal. The mammal can be a primate. The primate can be a human. The individual can be an individual diagnosed with, suspected of having, or at risk of a disease or condition. The disease or condition can be a disease or condition resulting in inflammation of a tissue of an individual, also referred to as an inflammatory disorder. The disease or condition causing inflammation can be disease or condition characterized by a deficiency in IL-10 expression. Treating the disease or condition (e.g., inflammatory disorder) can comprise administering a therapeutically effective amount of IL-10 or an IL-10 delivery construct to an individual suffering from, suspected of suffering from, or in relapse from the disease or condition (e.g., inflammatory disorder).

The term, "therapeutically effective amount," as used herein, can mean that the amount, e.g. of IL-10 or an IL-10 delivery construct, contained in a composition, e.g. formulation or oral formulation described herein, administered is of sufficient quantity to achieve the intended purpose, such as, for example, to treat a disease or condition, e.g. a disease or condition causing inflammation. In some embodiments, administering a formulation to an individual comprises administering a therapeutically effective amount of the formulation to the individual.

The individual in need thereof can be an individual refractory or resistant to at least one anti-inflammatory agent. The anti-inflammatory agent can be an aminosalicylate. The aminosalicylate can be 5-aminosalicylic acid (5-ASA; mesalazine), 4-amino salicylic acid (4-ASA), balsalazide, olsalazine, sulfasalazine, or a combination thereof. The anti-inflammatory agent can be a corticosteroid. The corticosteroid can be an orally administered corticosteroid or an intravenously (IV) administered corticosteroid. The corticosteroid can be prednisone. The anti-inflammatory agent can be an immunosuppressive agent. The immunosuppressive agent can be azathioprine, 6-mercaptopurine, or a combination thereof. The anti-inflammatory agent can be a TNFα inhibitor. The TNFα inhibitor can be adalimumab, certolizumab, etanercept, golimumab, infliximab, or a combination thereof. The at least one anti-inflammatory agent can be a Janus kinase (JAK) inhibitor. The JAK inhibitor can be filgotinib, upadacitinib, peficitinib, tofacitinib, or a combination thereof. The at least one anti-inflammatory agent can be a sphingosine-1-phosphate (SIP) receptor antagonist. The SIP receptor antagonist can be ozanimod, amiselimod, etrasimod, or a combination thereof. The at least one anti-inflammatory agent can be an integrin blocker. The integrin blocker can be etrolizumab, natalizumab, vedolizumab, abrilumab, carotegrast methyl, or a combination thereof. The at least one anti-inflammatory agent can be an IL-23 inhibitor. The IL-23 inhibitor can be ustekinumab, mirikizumab, brazikumab, guselkumab, risankizumab, or a combination thereof. The at least one anti-inflammatory agent can be a phosphodiesterase 4 (PDE4) inhibitor. The at least one PDE4 inhibitor can be apremilast, cilomilast, roflumilast, tetomilast, rolipram, or a combination thereof. The at least one anti-inflammatory agent can be laquinimod.

In some cases, the individual in need thereof can be an individual who has not been treated with an anti-inflammatory agent. In some cases, the individual in need thereof can be an individual who has not been treated with 5-ASA. In some cases, the individual in need thereof can be an individual who has responded partially or substantially to 5-ASA. In some cases, the individual in need thereof may be treated with an IL-10 delivery construct and 5-ASA.

In some embodiments, the oral formulations comprising an IL-10 delivery construct described herein are orally administered to an individual in need thereof. In some embodiments, the formulations comprising an IL-10 delivery construct described herein are rectally administered to an individual in need thereof. The formulations comprising the IL-10 delivery construct can be administered to the individual for at least 1, 2, 3, 4, 5, 6, 7, 8, 9, 10, 11, 12, 13, or 14 days. The formulation can be administered once a day, twice a day, or three times a day. The individual in need thereof can be a human. An individual in need thereof can be an individual diagnosed with, suspected of having, or at risk of a disease or condition causing inflammation. The disease or condition causing inflammation can be a disease or condition characterized by a deficiency in IL-10 expression. The disease or condition causing inflammation can be ulcerative colitis, inflammatory bowel disease (IBD), Celiac disease, proctitis, pouchitis, Crohn's disease, multiple sclerosis (MS), systemic lupus erythematosus (SLE), graft versus host disease (GVHD), rheumatoid arthritis, psoriatic arthritis, or psoriasis. The ulcerative colitis can be mild-to moderate ulcerative colitis or moderate-to-severe ulcerative colitis. The Crohn's disease can be fistulizing Crohn's disease. In some embodiments, the oral formulation is used in the treatment of the disorder causing inflammation. The oral formulation can be used to treat the disorder causing inflammation. The method can comprise administering a dose of an oral formulation comprising IL-10 and one or more pharmaceutically acceptable excipients to an individual. Administration of the dose of the oral formulation to the individual can result in an immunomodulatory response.

The immunomodulatory response can comprise a decrease in a concentration of fecal calprotectin (FCP) relative to an FCP baseline. Fecal calprotectin is a biomarker of intestinal inflammation. The concentration of FCP can be determined from a fecal sample or from a colonic biopsy. The concentration of FCP can be determined by an immunoassay. The immunoassay can be an enzyme linked immunoassay (ELISA). In some embodiments, concentration of FCP is expressed in mg of calprotectin per kilogram of feces or μg of calprotectin per gram of feces. The decrease in the concentration of FCP can be a decrease of at least 20%, 30%, 40%, or 50% relative to the FCP baseline. The decrease in the concentration of FCP can be a decrease of from about 50% to about 80% relative to the FCP baseline. In some embodiments, the concentration of FCP is decreased to 50 μg/g or less. In some embodiments, the decrease in the concentration of FCP indicates a decrease in gastrointestinal inflammation.

The FCP baseline can be an initial concentration of FCP in an individual or population prior to the administration. The initial concentration of FCP can be indicative of having a disease. An initial concentration of FCP indicative of a disease can be an FCP concentration of greater than 150 μg/g. In some embodiments, an FCP concentration of greater than 150 μg/g is indicative of having ulcerative colitis (UC). In some embodiments, the concentration of FCP is decreased at least 50% relative to the initial concentration of FCP and the dose of the oral formulation is from about 1 mg to about 3 mg.

The FCP baseline can be a placebo-adjusted FCP baseline. The placebo-adjusted FCP baseline can be a percent change of FCP concentration following administration of a placebo to an individual or population relative to initial FCP concentration prior to the administration. In some embodiments, the concentration of FCP in an individual or population treated with an IL-10 delivery construct is decreased at least 20% relative to the placebo-adjusted FCP baseline and the dose of the oral formulation of the IL-10 delivery construct is from about 1 mg to about 3 mg.

In one illustrative example, a placebo-administered individual or population starts with an FCP concentration of 200 μg/g and increases to 250 μg/g after the administration of a placebo (representing a 25% increase) and an IL-10 delivery construct administered individual or population starts with an FCP concentration of 200 μg/g and decreases to 100 μg/g after the administration of an IL-10 delivery construct (representing a 50% decrease). In this example, the FCP concentration of the IL-10 delivery construct administered individual or population can be said to: (i) have a 50% reduction in FCP concentration when the FCP baseline is an initial concentration of FCP in the IL-10 delivery construct administered individual or population prior to the administration, or (ii) have a 75% reduction (50%+25%) in FCP concentration when the FCP baseline is the placebo-adjusted FCP baseline.

In another illustrative example, a placebo administered individual or population starts with an FCP concentration of 200 μg/g and decreases to 150 μg/g after the administration of a placebo (representing a 25% decrease) and an IL-10 delivery construct administered individual or population starts with an FCP concentration of 200 μg/g and decreases to 100 μg/g after the administration of an IL-10 delivery construct (representing a 50% decrease). In this example, the FCP concentration of the IL-10 delivery construct administered individual or population can be said to: (i) have a 50% reduction in FCP concentration when the FCP baseline is an initial concentration of FCP in the IL-10 delivery construct administered individual or population prior to the administration, or (ii) have a 25% reduction (50%-25%) in FCP concentration when the FCP baseline is the placebo-adjusted FCP baseline.

The immunomodulatory response can comprise a decrease in a concentration of C-Reactive Protein (CRP) relative to a CRP baseline. C-Reactive Protein (CRP) is a biomarker of systemic inflammation. The concentration of CRP can be determined from a blood sample. The CRP concentration can be a serum CRP concentration. The concentration of CRP can be determined by an immunoassay or a nephelometric assay. The immunoassay can be an enzyme linked immunoassay (ELISA). The decrease in the concentration of CRP can be a decrease of at least at least 5%, 10%, 20%, 30%, 40%, 50%, 60%, 70%, or 80% relative to the CRP baseline. The decrease in the concentration of CRP can be a decrease of from about 5% to about 60%, from about 10% to about 50%, from about 30% to about 90%, or from about 40% to about 80% relative to the CRP baseline. In some embodiments, the concentration of CRP is decreased to less than 5 mg/L. In some embodiments, the decrease in the concentration of CRP indicates a decrease in systemic or gastrointestinal inflammation.

The CRP baseline can be an initial concentration of CRP in an individual or population prior to the administration. The initial concentration of CRP can be indicative of having a disease. An initial concentration of CRP indicative of a disease can be a CRP concentration of greater than 5 mg/L. In some embodiments, a CRP concentration of greater than 5 mg/L is indicative of irritable bowel disease (IBD). In some embodiments, the concentration of CRP is decreased at least 40% relative to the initial concentration CRP and the dose of the oral formulation is from about 1 mg to about 3 mg.

The CRP baseline can be a placebo-adjusted CRP baseline. The placebo-adjusted CRP baseline can be a percent change of CRP concentration following administration of a placebo to a placebo administered individual or population relative to initial CRP concentration prior to the administration. In some embodiments, the concentration of CRP in an individual or population treated with an IL-10 delivery construct is decreased at least 10% relative to the placebo-adjusted CRP baseline and the dose of the oral formulation of the IL-10 delivery construct is about 3 mg. In some embodiments, the concentration of CRP in an individual or population treated with an IL-10 delivery construct is decreased at least 40% relative to the placebo-adjusted CRP baseline and the dose of the oral formulation of the IL-10 delivery construct is about 1 mg.

In one illustrative example, a placebo-administered individual or population starts with a CRP concentration of 8 mg/L and increases to 10 mg/L after the administration of a placebo (representing a 25% increase) and an IL-10 delivery construct-administered individual or population starts with a CRP concentration of 8 mg/L and decreases to 4 mg/L after the administration of an IL-10 delivery construct (representing a 50% decrease). In this example, the CRP concentration of the IL-10 delivery construct administered individual or population can be said to: (i) have a 50% reduction in CRP concentration when the CRP baseline is an initial concentration of CRP in the IL-10 delivery construct-administered individual or population prior to the administration, or (ii) have a 75% reduction (50%+25%) in CRP concentration when the CRP baseline is the placebo-adjusted CRP baseline.

In another illustrative example, a placebo-administered individual or population starts with a CRP concentration of 8 mg/L and decreases to 6 mg/L after the administration of a placebo (representing a 25% decrease) and an IL-10 delivery construct-administered individual or population starts with a CRP concentration of 8 mg/L and decreases to 4 mg/L after the administration of an IL-10 delivery construct (representing a 50% decrease). In this example, the CRP concentration of the IL-10 delivery construct administered individual or population can be said to: (i) have a 50% reduction in CRP concentration when the CRP baseline is an initial concentration of CRP in the IL-10 delivery construct administered individual or population prior to the administration, or (ii) have a 25% reduction (50%-25%) in CRP concentration when the CRP baseline is the placebo-adjusted CRP baseline.

The immunomodulatory response can comprise a decrease in a Geboes score relative to a Geboes score baseline. Geboes scoring system is a standard measure of histological response (Geboes et al. Gut. 2000 September; 47(3):404-9). As used herein, a Geboes score can be a 0-22 point histologic scoring system in which higher scores represent more severe disease. The Geboes score baseline can be an initial Geboes score of an individual or population prior to the administration. The Geboes score baseline can be a placebo-adjusted Geboes score baseline. The placebo-adjusted Geboes score baseline can be a difference of a Geboes score following administration of a placebo to an individual or population from an initial Geboes score prior to administration of the placebo. In some embodiments, the Geboes score is decreased a least 2 units relative to the placebo-adjusted Geboes score baseline and the dose of the oral formulation is from about 1 mg to about 30 mg.

In one illustrative example, a placebo-administered individual or population starts with a Geboes score of 10, which increases to 12 following administration of a placebo (representing an increase of 2 units or 20%) and an IL-10 delivery construct individual or population starts with a Geboes score of 10, which decreases to 5 following administration of an IL-10 delivery construct (representing a decrease of 5 units or 50%). In this example the Geboes score of the IL-10 delivery construct administered individual can be said to: (i) have a decrease of 5 units or 50% when the Geboes score baseline is the initial Geboes score of the IL-10 delivery construct administered individual, or (ii) have a decrease of 7 units or 70% (50%+20%) when the Geboes score baseline is the placebo-adjusted Geboes score baseline.

In another illustrative example, a placebo-administered individual or population starts with a Geboes score of 10, which decreases to 8 following administration of a placebo (representing an decrease of 2 units or 20%) and an IL-10 delivery construct individual or population starts with a Geboes score of 10, which decreases to 5 following administration of an IL-10 delivery construct (representing a decrease of 5 units or 50%). In this example the Geboes score of the diseased individual can be said to: (i) have a decrease of 5 units or 50% when the Geboes score baseline is the initial Geboes score of the IL-10 delivery construct administered individual, or (ii) have a decrease of 3 units or 30% (50%-20%) when the Geboes score baseline is the placebo-adjusted Geboes score baseline.

In some embodiments, the immunomodulatory response comprises a decrease in a concentration of FCP relative to an FCP baseline and a decrease in a concentration of CRP relative to a CRP baseline. In some embodiments, the immunomodulatory response comprises a decrease in a concentration of FCP relative to an FCP baseline and a decrease in a Geboes score relative to a Geboes score baseline. In some embodiments, the immunomodulatory response comprises a decrease in a concentration of CRP relative to a CRP baseline and a decrease in a Geboes score relative to a Geboes score baseline. In some embodiments, the immunomodulatory response comprises a decrease in a concentration of FCP relative to an FCP baseline, a decrease in a concentration of CRP relative to a CRP baseline, and a decrease in a Geboes score relative to a Geboes score baseline.

Colonic tissue of an individual with a gastrointestinal inflammatory disorder can show infiltration of the lamina propria by mononuclear cells, eosinophils, and histiocytes, or a combination thereof in addition to neutrophilic infiltration into the epithelium associated with crypt architecture destruction, erosions, and ulcerations. Administration of an IL-10 delivery construct to an individual can results in a reduction in the infiltration of the lamina propria by mononuclear cells, eosinophils, and histiocytes, or a combination thereof in addition to neutrophilic infiltration into the epithelium associated with crypt architecture destruction, erosions, and ulcerations.

In some embodiments, less than 5%, less than 4%, less than 3%, less than 2%, or less than 1% of the IL-10 of the IL-10 delivery construct enters the bloodstream.

In some embodiments, the oral formulations comprising an IL-10 delivery construct described herein are orally administered to an individual in need thereof. The formulations comprising the IL-10 delivery construct can be administered to the individual for at least 1, 2, 3, 4, 5, 6, 7, 8, 9, 10, 11, 12, 13, or 14 days. The formulation can be administered once a day.

Administration of a therapeutically effective amount of a dose of an oral formulation from about 1 mg to about 60 mg to an individual can result in a greater than 20% increase in a plasma concentration of IL-1Ra in the individual relative to a baseline plasma concentration of IL-1Ra. In some embodiments, the baseline plasma concentration of IL-1Ra is a plasma concentration of IL-1Ra of the individual prior to the administration. In some embodiments, the dose of the oral formulation is from about 3 mg to about 30 mg and the increase in the plasma concentration of IL-1Ra relative to the baseline plasma concentration of IL-1Ra is greater than 30%. In some embodiments, the dose of the oral formulation is from about 3 mg to about 30 mg and the increase in the plasma concentration of IL-1Ra relative to the baseline plasma concentration of IL-1Ra is from 30% to 45%. In some embodiments, the dose of the oral formulation is from about 3 mg to about 10 mg and the increase in the plasma concentration of IL-1Ra relative to the baseline plasma concentration of IL-1Ra is from 30% to 35%. In some embodiments, the dose of the oral formulation is about 30 mg and the increase in the plasma concentration of IL-1Ra relative to the baseline plasma concentration of IL-1Ra is from 40% to 43%. The dose of the oral formulation can refer to the amount of IL-10 or an IL-10 delivery construct in the oral formulation.

Administration of the dose of oral formulation to the individual can result in a plasma concentration of IL-10 in the individual that does not exceed 1500 pg/mL, 1000 pg/mL, 900 μg/mL, 800 pg/mL, 700 pg/mL, 600 pg/mL, 500 pg/mL, 400 pg/mL, 300 pg/mL, 200 pg/mL, 100 pg/mL, 50 pg/mL, or 10 pg/mL. Administration of the dose of oral formulation to the individual can result in a plasma concentration of IL-10 in the individual that does not exceed 1500 pg/mL. Administration of the dose of oral formulation to the individual can result in a plasma concentration of IL-10 in the individual that does not exceed 1000 pg/mL. Administration of the dose of oral formulation to the individual can result in a plasma concentration of IL-10 in the individual that does not exceed 500 pg/mL. Administration of the dose of oral formulation to the individual can result in a plasma concentration of IL-10 in the individual that does not exceed 100 pg/mL.

Administration of a therapeutically effective amount of a formulation comprising IL-10 to an individual can result in an increase in a concentration of IL-1Ra in plasma of the individual can result in an increase in a concentration of IL-1Ra in plasma of the individual of at least 5000 μg/mL relative to a baseline level of IL-1Ra. The baseline level of IL-1Ra can be a typical concentration of IL-1Ra in the plasma of the individual prior to the administration. The concentration of IL-1Ra can reach a maximum of at least 5000 pg/mL, 6000 pg/mL, 7000 μg/mL, 8000 pg/mL, 9000 pg/mL, 10,000 pg/mL, 11,000 pg/mL, 12,000 pg/mL, 15,000 pg/mL, 20,000 pg/mL, or 25,000 pg/mL. The concentration of IL-1Ra can reach a maximum of from 1000 pg/mL to 10,000 pg/mL, from 8000 pg/mL to 12,000 pg/mL, or from 25,000 pg/mL to 28,000 pg/mL. The maximum concentration of IL-1Ra can be reached after at least 1, 2, 3, or 4 hours. The maximum concentration of IL-1Ra can be reached from 2 to 4 hours, from 2 to 3 hours, or from 3 to 4 hours after the administration. In one example, a concentration of IL-1Ra can reach a maximum of from 25,000 pg/mL to 28,000 pg/mL at from 2.5 hours to 3.5 hours post administration. In another example, a concentration of IL-1Ra can reach a maximum of from 8,000 pg/mL to 12,000 pg/mL at from 3.5 hours to 4.5 hours post administration.

Administration of a therapeutically effective amount of a formulation comprising IL-10 to an individual with a disease or condition (e.g., inflammatory disorder) can result in at least one of (1) a peak IL-10 concentration of less than 50 pg/mL in the plasma of the individual and (2) co-localization of the IL-10 with a cell expressing CD3 in a lamina propria of the individual. The peak IL-10 concentration can be less than 50 pg/mL, 40 pg/mL, 30 pg/mL, 20 pg/mL, 10 μg/mL, 2.5 pg/mL, 2.0 pg/mL, 1.5 pg/mL, or 1.0 pg/mL. The peak IL-10 concentration can be reached from 1 hour to 5 hours, from 1 hour to 3 hours, from 2 hours to 3 hours, or from 3 hours to 5 hours after the administration. The cell expressing CD3 can be a lymphocyte. The lymphocyte can be a T cell.

Administration of a therapeutically effective amount of a formulation comprising IL-10 to an individual with a disease or condition (e.g., inflammatory disorder) can result in an increase in a ratio of expression of IL-Ra to interleukin 1 beta (IL-1β) (IL-1Ra:IL-1β) in the colonic tissue of the individual. The ratio of IL-1Ra:IL-1β can beat least 1:1, 1.5:1, 2:1, 2.5:1, or 3:1. The ratio of IL-1Ra:IL-1β can be from 2:1 to 3:1.

Administration of a therapeutically effective amount of a formulation comprising IL-10 to an individual with a disease or condition (e.g., inflammatory disorder) can result in no significant increase in a concentration of at least one pro-inflammatory cytokine in plasma of the individual. The at least one pro-inflammatory cytokine can be interferon gamma (IFN-γ), IL-1β, interleukin 2 (IL-2), interleukin 8 (IL-8), or a combination thereof. Administration of a therapeutically effective amount of a formulation comprising IL-10 to an individual with a disease or condition (e.g., inflammatory disorder) can result in an increase in a concentration of IL-1Ra in plasma of the individual. The concentration of IL-1Ra can reach a maximum of from 25,000 pg/mL to 28,000 pg/mL at from 2.5 hours to 3.5 hours post administration.

Administration of a therapeutically effective amount of a formulation comprising IL-10 to an individual with a disease or condition (e.g., inflammatory disorder) can result in: (a) an increase in expression of interleukin 1 receptor agonist (IL-1Ra) in a colonic tissue of the individual; (b) a decrease in expression of at least one pro-inflammatory gene in the colonic tissue; (c) an increase in expression of at least one anti-inflammatory gene in the colonic tissue of the individual; (d) an increase in expression of at least one tissue repair gene in the colonic tissue of the individual; (e) an increase in expression of at least one anti-microbial gene in the colonic tissue of the individual; or (f) a combination thereof. In some embodiments, administration of a therapeutically effective amount of a formulation comprising IL-10 to an individual with a disease or condition (e.g., inflammatory disorder) results in an increase in a ratio of expression of Il-1Ra to interleukin 1 beta (IL-1R:IL-1β) in the colonic tissue of the individual. The ratio of IL-1R:IL-1β can be greater than 1:1, 1.5:1, 2:1, 2.5:1, or 3:1.

The at least one pro-inflammatory gene can be MHC-II, HPGDS, FCER1A, PLA2G2D, CCL13, FUT3, CCL28, UGT1A1, CCL20, NLRP1, TPH, or a combination thereof. The at least one anti-inflammatory gene can be CD163, SCNN1G, STC1, HGF, SGK1, miR-24-2, SCNN1B, PTGDR, MTNR1A, ACE2, NOX2, BEST2, VNN2, LTB4R2, B2GALT5, or a combination thereof. The at least one tissue repair gene can be SCNN1G, STC1, TIMP1, SCNN1B, BEST2, B3GALT5, or a combination thereof. The at least anti-microbial gene can be PI15, PI3, BDKRB1, CCI28, SERPINE2, or a combination thereof.

Further described herein, in certain embodiments, are methods of preventing a recurrence of an inflammatory disorder in an individual in remission for the inflammatory disorder, comprising administering a formulation comprising IL-10 and one or more pharmaceutically acceptable excipients to the individual. The individual can have been in remission for the inflammatory disorder for at least one month, 6 months, 8 months, 1 year, 2 years, 3 years, 4 years, or 5 years.

Described herein, in certain embodiments, are methods of treating an inflammatory disorder in an individual refractory or resistant to at least one anti-inflammatory agent, the method comprising administering a formulation comprising IL-10 to the individual. The anti-inflammatory agent can be an aminosalicylate. In some embodiments, the aminosalicylate is selected from the group consisting of 5-aminosalicylic acid (5-ASA; mesalazine), 4-amino salicylic acid (4-ASA), balsalazide, olsalazine, and sulfasalazine. The anti-inflammatory agent can be a corticosteroid. In some embodiments, the corticosteroid is prednisone. In some embodiments, the corticosteroid is an orally administered corticosteroid or an intravenously (IV) administered corticosteroid. The anti-inflammatory agent can be an immunosuppressive agent. In some embodiments, the immunosuppressive agent is selected from the group consisting of azathioprine, 6-mercaptopurine, and a combination thereof. The anti-inflammatory agent can be a TNFα inhibitor. In some embodiments, the TNFα inhibitor is selected from the group consisting of adalimumab, certolizumab, etanercept, golimumab, and infliximab. The at least one anti-inflammatory agent can be a Janus kinase (JAK) inhibitor. In some embodiments, the JAK inhibitor is selected from the group consisting of filgotinib, upadacitinib, peficitinib, and tofacitinib. The at least one anti-inflammatory agent can be a sphingosine-1-phosphate (SIP) receptor antagonist. In some embodiments, the SIP receptor antagonist is selected from the group consisting of ozanimod, amiselimod, and etrasimod. The at least one anti-inflammatory agent can be an integrin blocker. In some embodiments, the integrin blocker is selected from the group consisting of etrolizumab, natalizumab, vedolizumab, abrilumab, and carotegrast methyl. The at least one anti-inflammatory agent can be an IL-23 inhibitor. In some embodiments, the IL-23 inhibitor is selected from the group consisting of ustekinumab. mirikizumab, brazikumab, guselkumab, and risankizumab. The at least one anti-inflammatory agent can be a phosphodiesterase 4 (PDE4) inhibitor. In some embodiments, the at least one PDE4 inhibitor is selected from the group consisting of apremilast, cilomilast, roflumilast, tetomilast, and rolipram. The at least one anti-inflammatory agent can be laquinimod. In some embodiments, the individual is administered the formulation daily for at least 5, 7, 10, 12, or 14 days.

Combination Therapies

Provided herein are methods of treating an inflammatory disease in a subject in need thereof, comprising administering an IL-10 therapeutic in combination with a non-IL-10 immunosuppressor. In some cases, the IL-10 therapeutic is an oral therapeutic. In some cases, treatment with the non-IL-10 immunosuppressor is commenced prior to treatment with the oral IL-10 therapeutic. In some cases, treatment with the non-IL-10 immunosuppressor is commenced concomitantly with treatment with the oral IL-10 therapeutic. In some cases, the subject has previously been treated with a non-IL-10 immunosuppressor and had an inadequate response. In some cases, the subject is predicted to respond inadequately to a non-IL-10 immunosuppressor based on medical history, family history, genetics, or expression of biomarkers. In some cases, the non-IL-10 immunosuppressor is not an interleukin.

In some cases, the non-IL-10 immunosuppressor is an anti-integrin therapy, for example vedolizumab. In some cases, the non-IL-10 immunosuppressor is a Janus kinase inhibitor (JAK inhibitor). In some cases, the non-IL-10 immunosuppressor is an IL-23 antagonist and/or an IL-12/IL-23 antagonist. In some cases, the non-IL-10 immunosuppressor is a Sphingosine-1-phosphate (SIP) modulator or a Sphingosine-1-phosphate receptor modulator. In other cases, the non-IL-10 immunosuppressor is IL-22 or an IL-22 agonist.

In some cases, the non-IL-10 immunosuppressor is a TNF alpha inhibitor. In some cases, treatment with the TNF alpha inhibitor is commenced prior to treatment with the IL-10 therapeutic. In some cases, treatment with the TNF alpha inhibitor is commenced concomitantly with treatment with the IL-10 therapeutic. In some cases, the subject has previously been treated with a TNF alpha inhibitor and had an inadequate response. In some cases, the subject is predicted to respond inadequately to a TNF alpha inhibitor based on medical history, family history, genetics, or expression of biomarkers.

Further provided are methods of treating an inflammatory disease in a subject, wherein the subject has had an inadequate response to treatment with a TNF alpha inhibitor, the method comprising administering an IL-10 therapeutic. In some cases, treatment with the TNF alpha inhibitor is continued concomitantly with the IL-10 therapeutic.

In some cases, the inflammatory disease may be a disease of the intestines or digestive tract. In some cases, the inflammatory disease may manifest or present in a tissue distal to or at a remote distance from the digestive tract. In some cases, the inflammatory disease may be selected from the group consisting of. inflammatory bowel disease, psoriasis, plaque psoriasis, hidradenitis suppurativa, psoriatic arthritis, rheumatoid arthritis, juvenile idiopathic arthritis, ankylosing spondylitis, bacterial sepsis, Crohn's disease, fistulizing Crohn's disease, moderate-to-severe ulcerative colitis, mild-to-moderate ulcerative colitis, ulcerative colitis, collagenous colitis, lymphocytic colitis, ischaemic colitis, diversion colitis, Behcet's syndrome, indeterminate colitis, rheumatoid arthritis, pancreatitis, liver inflammation, pouchitis, proctitis, uveitis, graft vs host disease, and epithelial cell injury. In some cases, the inflammatory disease is rheumatoid arthritis. In some cases, the inflammatory disease is an inflammatory bowel disease. In some cases, the inflammatory bowel disease is ulcerative colitis. In some cases, the inflammatory bowel disease is Crohn's disease.

In some cases, an IL-10 therapeutic may be administered locally to a site of disease. For example, an IL-10 therapeutic may be administered orally to treat a disease of the digestive tract such as ulcerative colitis or Crohn's disease. In some cases, the IL-10 therapeutic may be administered orally to achieve a systemic dose which may treat a disease distal to the digestive tract. For example, an IL-10 therapeutic may be administered orally to treat rheumatoid arthritis or psoriasis.

An inadequate response to a therapeutic may comprise a partial response, or a lack of response. In some cases, an inadequate response is a response other than a complete cure or complete remission of a disease. A subject who has had an inadequate response to a therapeutic may have fewer symptoms or may have less severe symptoms during or after the treatment as compared to prior to the treatment. In other cases, a subject who has had an inadequate response to a disease may have the same number of symptoms or the same symptoms as prior to treatment. In some cases, a subject who has had an inadequate response to a therapeutic may have more symptoms or more severe symptoms after treatment as compared to prior to treatment.

In some cases, a subject with rheumatoid arthritis who has had an inadequate response to a therapeutic may continue to have one or more symptoms of arthritis after treatment with the therapeutic (e.g., an anti-TNF alpha inhibitor alone). For example, the subject may have one or more joints with active disease. Active disease may be identified by fluorescent optical imaging or magnetic resonance imaging. The subject with an inadequate response to a rheumatoid arthritis treatment may have one or more joints which are tender, and/or one or more joints which are swollen. Other symptoms which may be present include stiffness or weakness of joints, redness of the skin over joints, lumps over the joints, flare, dry mouth, physical deformity, or a sensation of pins and needles.

In some cases, a subject with ulcerative colitis who has had an inadequate response to a therapeutic may continue to have one or more symptoms of ulcerative colitis after treatment with the therapeutic (e.g., an anti-TNF alpha inhibitor alone). The subject with an inadequate response to an ulcerative colitis treatment may have a modified Mayo Clinic Score (MMS) of between about 4 points and about 9 points. The subject may have a centrally read MCS endoscopic sub score of grade 2 or higher. In some cases, the subject may have a MMS rectal bleeding sub score of 1 point or higher. In some cases, the subject may have disease extending 15 cm or more from the anal verge. Other symptoms of ulcerative colitis include abdominal pain/discomfort, blood or pus in stool, fever, weight loss, frequent recurring diarrhea, fatigue, reduced appetite, and tenesmus.

In some cases, a subject may have had an inadequate response after treatment with a TNF alpha inhibitor. In some cases, the subject may have had an inadequate response to the TNF alpha inhibitor after at least 6 or at least 12 weeks of treatment with the TNF alpha inhibitor.

The TNF alpha inhibitor may be a monoclonal antibody. Examples of anti-TNF alpha therapeutics include of infliximab (Remicade), adalimumab (Humira) and golimumab (Simponi). In some cases, the TNF alpha inhibitor is etanercept. In some cases, the TNF alpha inhibitor is not etanercept.

The TNF alpha inhibitor may be administered by subcutaneous injection, or by any other suitable method. For example, adalimumab may be administered by subcutaneous injection. In some cases, adalimumab may be administered at a dose of 40 mg every other week. In some cases, one or more initial doses may be higher than a maintenance dose. For example, an adalimumab therapy regimen may comprise a first dose of 160 mg, followed by a second dose of 80 mg about two weeks later, followed two weeks later by maintenance doses of 40 mg every other week. In some cases, an initial dose of adalimumab may be 80 mg, followed two weeks later by maintenance doses of 40 mg every other week.

The TNF alpha inhibitor may be administered by intravenous infusion. For example, infliximab may be administered by intravenous infusion. In some cases, the TNF alpha inhibitor may be administered by intravenous infusion over a period of time of at least two hours. In some cases, infliximab may be administered at a dose of 5 mg/kg. In other cases, infliximab may be administered at a dose of 3 mg/kg, or at a dose of 10 mg/kg. In some cases, a treatment regimen may comprise more frequent initial doses, followed by maintenance doses. In some cases, a treatment regimen may comprise administering the TNF alpha inhibitor at 0, 2, and 6 weeks, then every 8 weeks.

The TNF alpha inhibitor may be administered by a medical professional or may be provided to a patient for self-administration. In some cases, the TNF alpha inhibitor may be provided in a single-dose prefilled syringe, or in a single dose automatic injector. For example, adalimumab may be provided in a single-dose HUMIRA Pen.

In some cases, an IL-10 therapeutic may be administered orally. In some cases, an IL-10 therapeutic may be administered approximately simultaneously with a TNF alpha inhibitor. For example, an IL-10 therapeutic may be administered immediately before, or immediately after a TNF alpha inhibitor. In some cases, an IL-10 therapeutic may be administered on the same day as a TNF alpha inhibitor, or on the day proceeding or day following administration of a TNF alpha inhibitor. For example, an IL-10 therapeutic and a TNF alpha inhibitor may be administered at 0, 2, and 6 weeks, and then subsequently every 8 weeks. In another example, an IL-10 therapeutic and a TNF alpha inhibitor may be administered every two weeks.

In some cases, an IL-10 therapeutic may be an IL-10 delivery construct.

EXAMPLES

Example 1: IL-10 Delivery Construct Design

IL-10 is an immunomodulatory cytokine that suppresses the activation and effector function of multiple innate and adaptive immune cells. An IL-10 delivery construct (SEQ ID NO: 5) was designed. This construct was a recombinant, homodimeric fusion protein where each monomer consisted of an N-terminal methionine, a cholix$^{386}$ domain (SEQ ID NO: 4) and a recombinant human IL-10 (rhIL-10) domain (SEQ ID NO: 2) connected by an amino acid polypeptide spacer of glycine and serine (polyGlySer) residues (SEQ ID NO: 6). The cholix$^{386}$ domain was a truncated form of a variant of cholix, a non-toxic mutant derived from *Vibrio cholera* containing 386 amino acids. The construct had a molecular weight of 125,796 Da, and an isoelectric point (pI) of 5.49.

The cholix$^{386}$ domain facilitates active transport of the IL-10 delivery construct of SEQ ID NO: 5 across epithelial cells via vesicular transcytosis to the local gastrointestinal submucosal tissue. Targeted delivery of the rhIL-10 directly to the lamina propria via the oral route may bypass one or more drawbacks experienced with systemic administration and translate into higher mucosal concentrations and clinically meaningful reductions in inflammation and disease.

As used in the examples herein, Drug Substance (DS) was used when referring to the lyophilized powder and Drug Product (DP) was used when referring to the capsule or tablet form.

Example 2: Expression of the Target Construct

Plasmids containing the coding sequence (SEQ ID NO: 10) of the target construct (SEQ ID NO: 5) were constructed by cloning into the Nde I and EcoR I sites of a pET26(b) backbone. The sequence encoded by SEQ ID NO: 10 is a codon-improved sequence for expression in bacterial cells. The plasmid contained the T7 promoter and conferred kanamycin resistance. BL21 *E. coli* cells were transfected with the target construct plasmid using a heat shock method of transformation as follows: BL21 cells and the target construct plasmid were aliquoted into a tube and incubated on ice for 30 minutes. The tubes were then heat shocked for 30 to 45 seconds at 42° C.±2° C. in a water bath. Immediately after the heat shock, the tubes were placed in ice for 2 to 5 minutes. Media was added into each tube and the tubes were incubated for 60 minutes at 37° C. The transformed cells were plated onto LB/Kan agar plates and incubated overnight at 37° C. A single colony was then picked from the agar plate, inoculated in 4 mL of LB media, and grown overnight in a shaker flask. Glycerol stock (80%) was added to the culture, which was then filled into cryovials and stored at −80±10° C. The pre-RCB (Research Cell Bank; the culture+glycerol stock) was then further manufactured to produce the master cell bank (MCB).

To produce the MCB, cells from the RCB were expanded in shake flasks until sufficient cell mass was accumulated, recovered by centrifugation, resuspended in cryopreservation medium, aliquoted into 300 cryovials, and cooled until frozen. The MCB was stored at −80±5° C. in a controlled access GMP facility. The MCB was manufactured and is maintained in accordance with cGMP procedures and ICH Guidelines Q5B and Q5D.

Following expansion in a shake flask, cells were transferred into a production bioreactor. Fermentation was executed in a 1500 L bioreactor in the presence of kanamycin for selective pressure. Production fermentation consists of a cell growth phase followed by an expression phase using isopropyl β-D-1-thiogalactopyranoside (IPTG) as an inducer, where the protein was expressed intracellularly as insoluble inclusion bodies. The production reactor was controlled at set pH, temperature, and dissolved oxygen level as specified in the manufacturing procedure: pH was controlled by phosphoric acid and ammonium hydroxide addition; dissolved oxygen was controlled by air and oxygen gas flows. All gases were passed through membrane filters of pore size 0.22 μm or less. The production reactor contained bacterial growth medium with defined components. Before inoculation, these ingredients were sterilized according to written standard operating procedures. The production phase was a fed batch process, where glucose-based feed media are added to maintain cell growth and culture viability.

At the end of production, the cells were harvested by centrifugation, and the cell paste processed further or frozen for processing at a later date. High-pressure homogenization was used to release the product-containing inclusion bodies. The inclusion bodies were then resuspended, washed, and separated from other cellular components by centrifugation. The inclusion bodies were either processed forward immediately or frozen for use at a later date. The cell paste and/or inclusion body slurry was stored at −20±5° C. prior to further use.

Example 3: Refolding Optimization

Solubilization of inclusion bodies (IBs) was carried out using a high concentration of guanidine hydrochloride, a strong chaotrope. Following solubilization, an initial effort using a traditional refolding approach reducing with DTT and then diluting into a redox cocktail generated a low yield of properly folded dimer (<5% dimer). A second approach utilizing a sulfitolysis generated a higher recovery and was implemented. The peptide was first reduced with sodium sulfite and then the free sulfhydryls were capped with potassium tetrathionate. Following diafiltration to remove the residual sulfitolysis reagents, the protein was diluted into a redox cocktail, which allowed the protein to refold and oxidize. Utilizing this approach, the yield was ~2-fold higher (~10% dimer) but still lower than desired. The effect of refolding in the presence of osmolytes, such as sucrose as well as other water modifying agents such as glycerol, was further investigated.

Figure 25B:
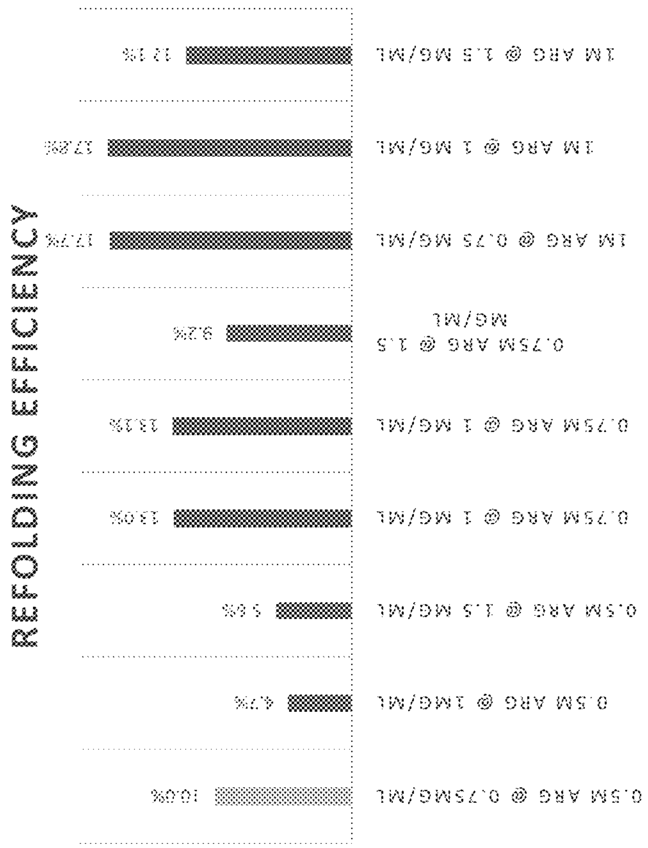
FIGS. 25A-25B illustrate refolding efficiency when varying arginine concentration and target construct (SEQ ID NO: 5) concentration of the refolding solution.
Figure 25A:
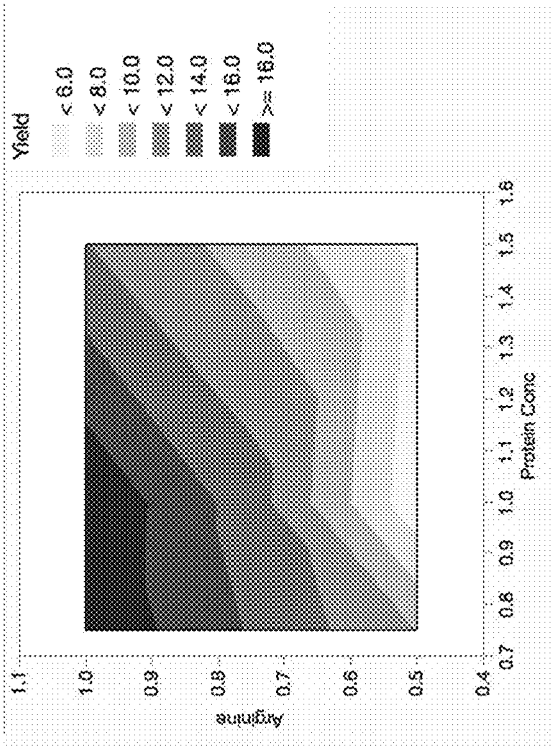
Figure 28:
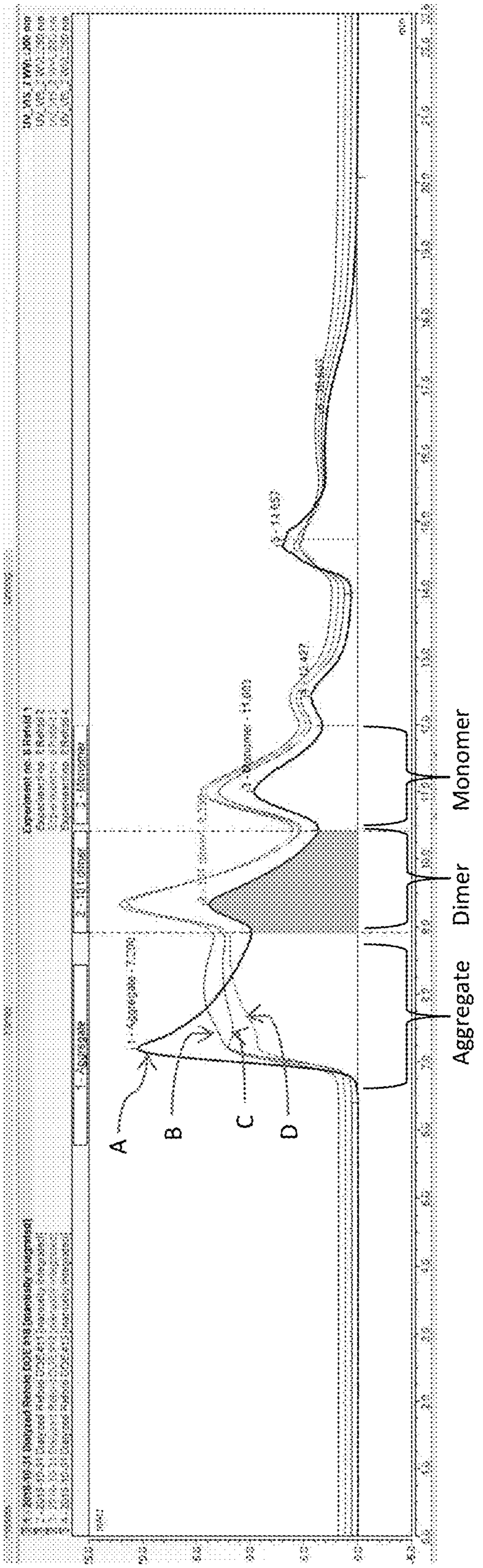
FIG. 28 illustrates a size exclusion high performance liquid chromatography (SE-HPLC) chromatogram showing target construct (SEQ ID NO: 5) aggregates, dimers, and monomers for each of four refolding solutions. "A" represents the control refolding solution containing 0.7 M arginine. "B" represents a refolding solution with 1M arginine. "C" represents a refolding solution with 1M arginine plus 0.25 M sucrose plus 0.2% PEG3350. "D" represents 1M arginine plus 0.25M sucrose.
Figure 29:
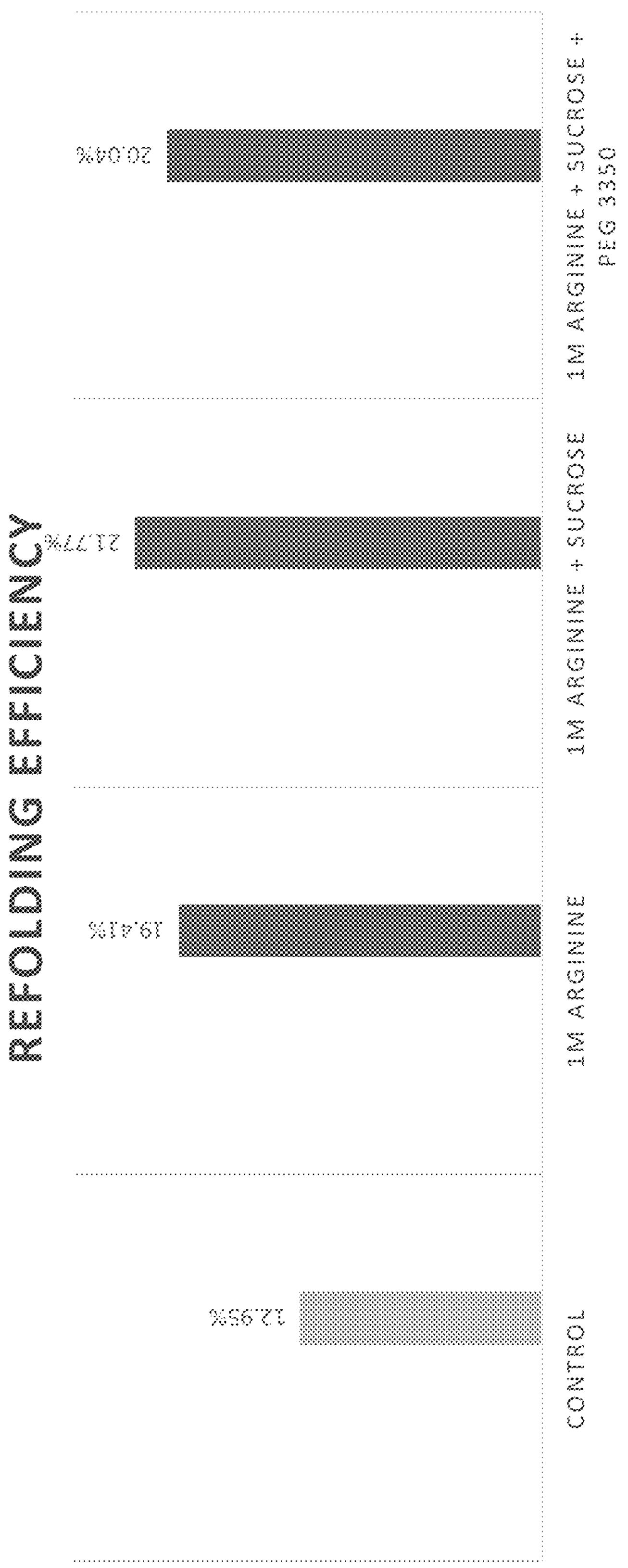
FIG. 29 illustrates refolding efficiency of each of the four refolding solutions illustrated in FIG. 28.

Refolding efficiency was assessed after varying arginine concentration and the target construct (protein) concentration of the refolding solution (TABLE 5; FIGS. 25A-25B). The refolding efficiency shown in the tables and figures in this example is equivalent to the percent dimers of the resulting refolded target constructs and was assessed by size exclusion high performance liquid chromatography (SE-HPLC). An example chromatogram showing dimer % from use of four different refolding solutions is shown in FIG. 28. The refolding efficiencies of the four refolding solutions illustrated in the chromatogram of FIG. 28 are shown in FIG. 29.

TABLE 5

Concentrations of components in nine refolding solutions varying arginine (M) and target construct concentrations (mg/mL)

| | Arginine | Protein Conc |
|---|---|---|
| 1 | 0.50 | 0.75 |
| 2 | 0.50 | 1.00 |
| 3 | 0.50 | 1.50 |
| 4 | 0.75 | 1.00 |
| 5 | 0.75 | 1.00 |
| 6 | 0.75 | 1.50 |
| 7 | 1.00 | 0.75 |
| 8 | 1.00 | 1 |
| 9 | 1.00 | 1.5 |

Figure 26B:
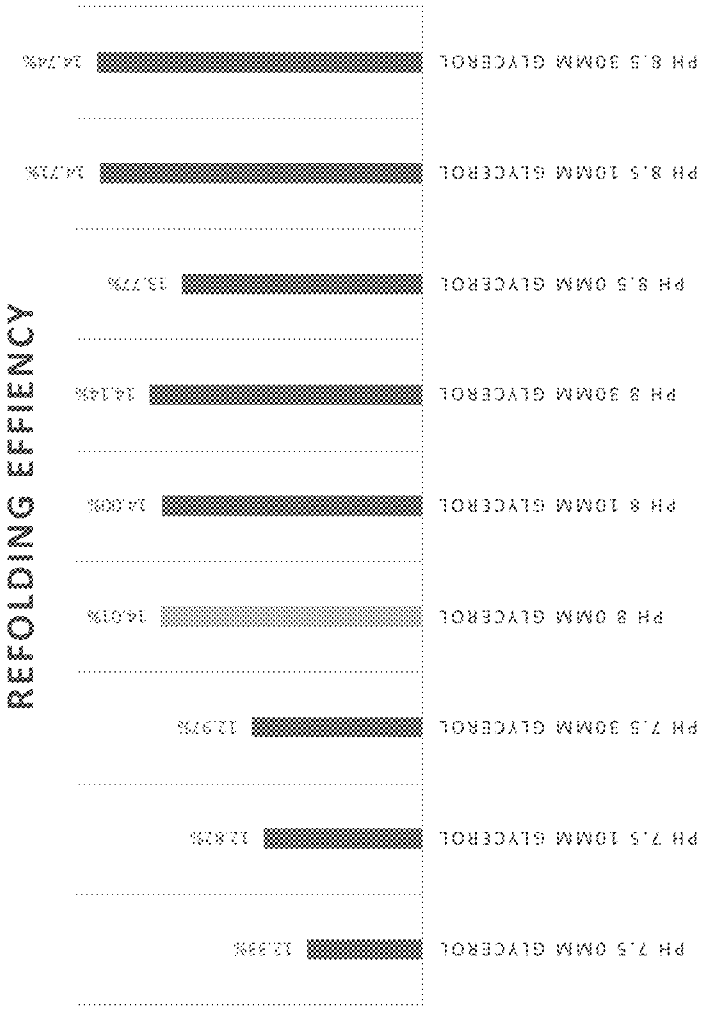
FIGS. 26A-26B illustrate refolding efficiency of the target construct (SEQ ID NO: 5) when varying glycerol concentration and pH of the refolding solution.
Figure 26A:
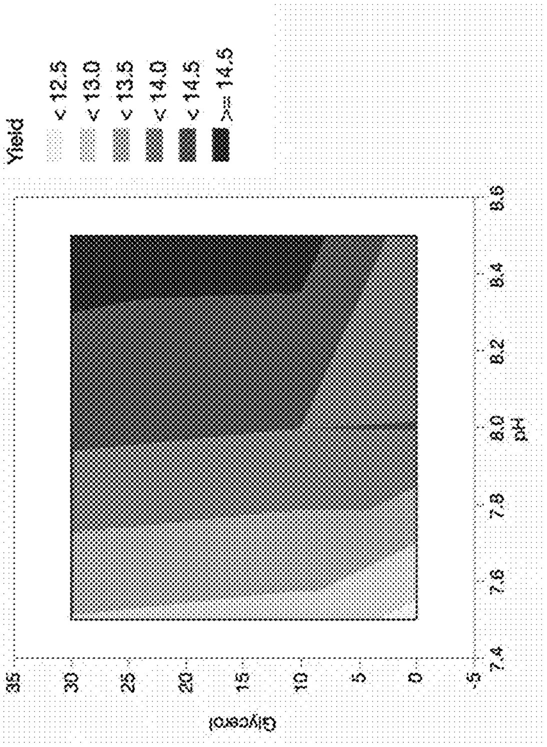

Refolding efficiency was assessed after varying the pH and glycerol concentration of the refolding solution (TABLE 6; FIGS. 26A-26B).

TABLE 6

Concentrations of components in nine refolding solutions varying glycerol (mM) concentration and pH

| | Arginine | Protein Conc | Glycerol | pH |
|---|---|---|---|---|
| 1 | 0.75 | 1.00 | 0 | 7.5 |
| 2 | 0.75 | 1.00 | 10 | 7.5 |
| 3 | 0.75 | 1.00 | 30 | 7.5 |
| 4 | 0.75 | 1.00 | 0 | 8 |
| 5 | 0.75 | 1.00 | 10 | 8 |
| 6 | 0.75 | 1.00 | 30 | 8 |
| 7 | 0.75 | 1.00 | 0 | 8.5 |
| 8 | 0.75 | 1.00 | 10 | 8.5 |
| 9 | 0.75 | 1.00 | 30 | 8.5 |

Figure 27B:
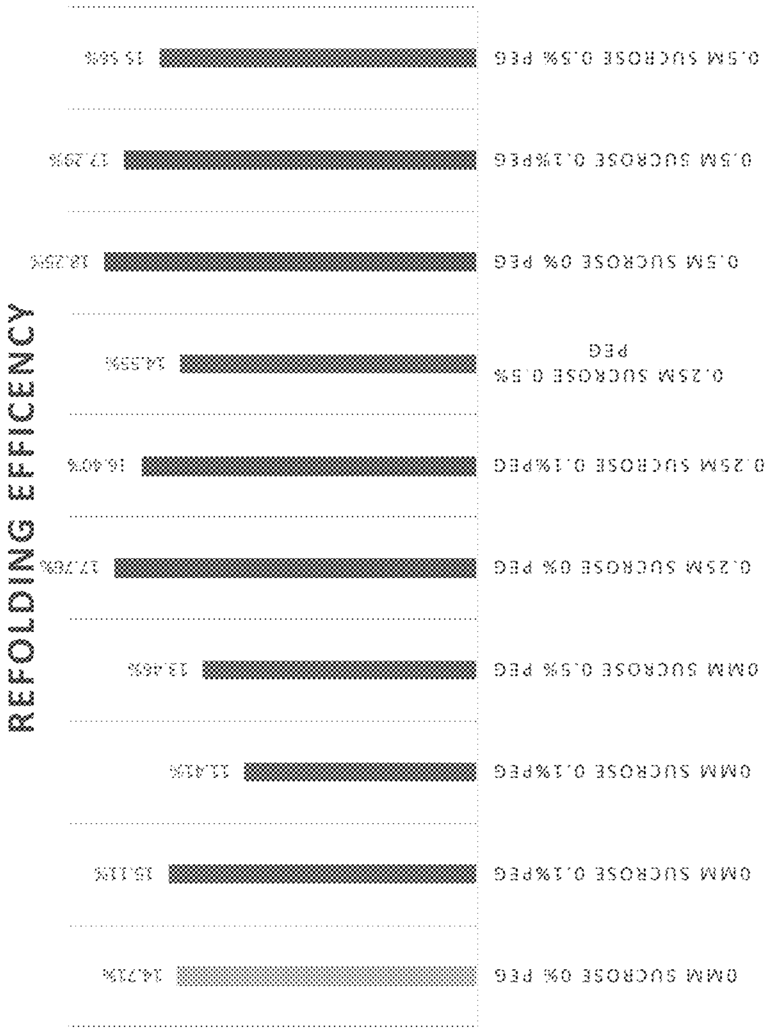
FIGS. 27A-27B illustrate refolding efficiency of the target construct (SEQ ID NO: 5) when varying sucrose concentration and PEG 3350 concentration of the refolding solution.
Figure 27A:
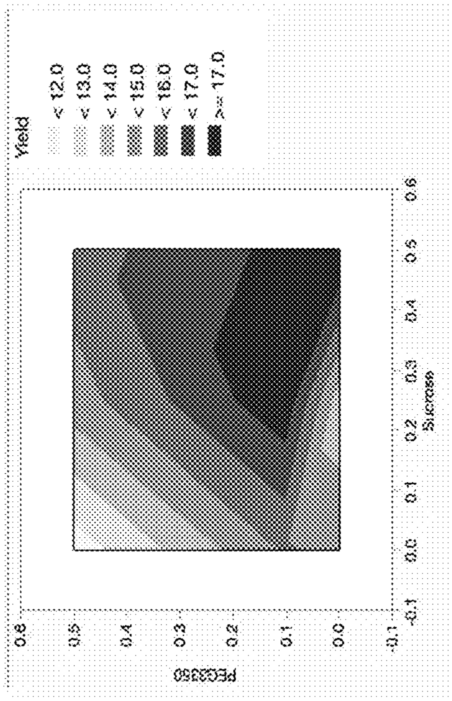

Refolding efficiency was assessed after varying sucrose concentration and PEG concentration of the refolding solution (TABLE 7; FIGS. 27A-27B).

TABLE 7

Concentrations of components in nine refolding solutions varying % PEG and sucrose concentrations (M)

| | Arginine | Protein Conc | PEG 3350 | Sucrose, M |
|---|---|---|---|---|
| 1 | 0.75 | 1.00 | 0 | 0 |
| 2 | 0.75 | 1.00 | 0.1 | 0 |
| 3 | 0.75 | 1.00 | 0.5 | 0 |
| 4 | 0.75 | 1.00 | 0 | 0.25 |

TABLE 7-continued

| Concentrations of components in nine refolding solutions varying % PEG and sucrose concentrations (M) | | | | |
|---|---|---|---|---|
| | Arginine | Protein Conc | PEG 3350 | Sucrose, M |
| 5 | 0.75 | 1.00 | 0.1 | 0.25 |
| 6 | 0.75 | 1.00 | 0.5 | 0.25 |
| 7 | 0.75 | 1.00 | 0 | 0.5 |
| 8 | 0.75 | 1.00 | 0.1 | 0.5 |
| 9 | 0.75 | 1.00 | 0.5 | 0.5 |

Refolding efficiency was assessed after varying sucrose, glycerol, and PEG concentration of the refolding solution (TABLE 8).

TABLE 8

| Concentrations of components in ten refolding solution and resulting refolding efficiency (dimer %) | | | | | | |
|---|---|---|---|---|---|---|
| | Arginine, M | Protein Conc, mg/ml | Sucrose, M | Glycerol, % | PEG 3350, % | Dimer (%) |
| 1 | 1.00 | 1.00 | 0 | 0 | 0.2 | 17.38% |
| 2 | 1.00 | 1.00 | 0.1 | 0 | 0 | 18.29% |
| 3 | 1.00 | 1.00 | 0.25 | 0 | 0 | 18.16% |
| 4 | 1.00 | 1.00 | 0 | 5 | 0.1 | 17.71% |
| 5 | 1.00 | 1.00 | 0.1 | 5 | 0.2 | 19.00% |
| 6 | 1.00 | 1.00 | 0.25 | 5 | 0.1 | 18.21% |
| 7 | 1.00 | 1.00 | 0 | 10 | 0 | 16.30% |
| 8 | 1.00 | 1.00 | 0.1 | 10 | 0.1 | 18.10% |
| 9 | 1.00 | 1.00 | 0.25 | 10 | 0.2 | 16.61% |
| 10 | 1.00 | 1.00 | 0.25 | 5 | 0 | 17.90% |

Example 4: Purification of Refolded Constructs

Several modes of chromatography were evaluated during process development. Cation exchange (CEX) was unsuccessful at relatively low pH as the protein would precipitate at a pH below the pI of the target construct (pH 5.5). Hydrophobic Interaction Chromatography (HIC) was also unsuccessful, as the protein appeared to be unstable in the high salt necessary for binding.

Anion exchange (AEX) worked well, as the protein was stable at higher pH and bound at reasonable capacity. Several AEX supports from various vendors were evaluated, with the Capto™ Q ImpRes giving the best overall performance, particularly with respect to the separation of the active dimer species from the two major product-related impurities, residual monomer and aggregated species. As a polishing step, ceramic hydroxyapatite (CHT) was implemented as a mixed-mode orthogonal step to further reduce product and process related impurities.

Figure 30:
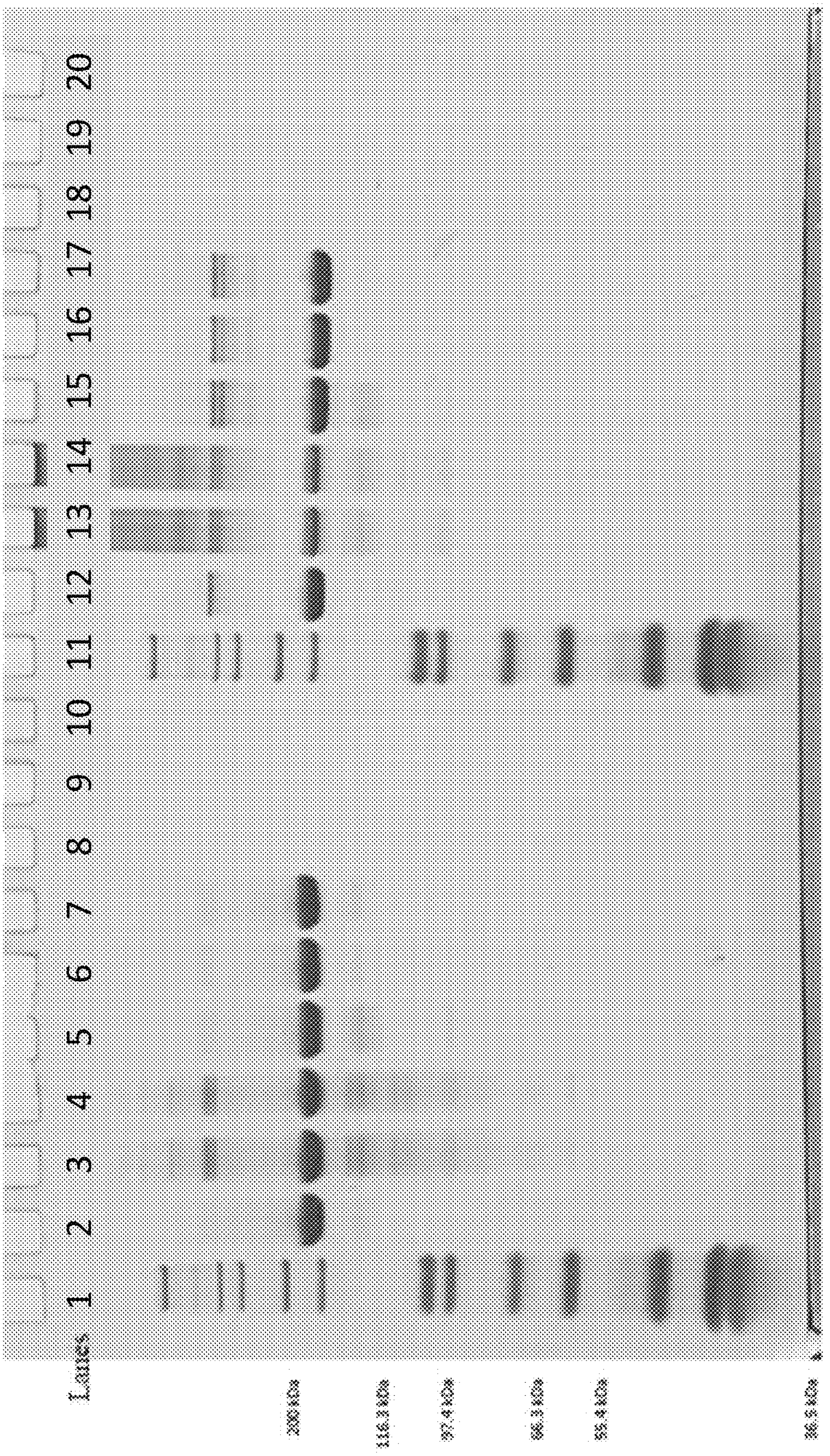
FIG. 30 illustrates Coomassie blue staining of target constructs at various intermediate steps in the purification process following SDS-PAGE. Lanes 1 and 11 contain mark 12 molecular weight markers. Lanes 8, 9, 10, 18, 19, and 20 are blank. The samples in lanes 2 through 10 SDS-PAGE were run in reduced conditions. The samples in lanes 12 through 20 were SDS-PAGE run in non-reduced conditions. Lanes 2 and 12 contain the target construct (SEQ ID NO: 5). Lanes 3 and 13 contain filtered TFF-2 retentate (Cycle #1). Lanes 4 and 14 contains filtered TFF-2 retentate (Cycle #2). Lanes 5 and 15 contains Capto™ Q pooled eluate. Lanes 6 and 16 contains the CHT pooled eluate. Lanes 7 and 17 contains the TFF-3 final retentate.

Refolded target constructs were subjected to AEX chromatograph followed by CHT chromatography. Gradient elutions on both chromatography steps were utilized for the initial clinical campaign, with the opportunity to develop optimized step elutions being evaluated as clinical development progresses. During elution, fractions were collected and each fraction assayed by SE-HPLC for dimer content of the target construct. Fractions containing above a specified threshold (e.g., 75%) were then pooled in order to meet the desired dimer content percentage. Following the CHT step, the final bulk was concentrated and diafiltered using UF/DF into the formulation buffer. SDS-PAGE analysis of the major process intermediates is shown in FIG. 30, which demonstrated an increase in dimer purity during downstream processing.

Example 5: Lyophilization of the Liquid Intermediate

In order to generate an oral capsule containing the IL-10 delivery construct, the purified liquid intermediate produced following the purification protocol described in Example 4, was transformed into a dried powder. Lyophilization was determined to be an appropriate way to produce the powder while minimizing aggregate formation.

Formulation development to establish the lyophilization buffer was performed by initially screening the freeze-thaw and shear-induced liquid stability of the target construct following dialysis into combinations of several components outlined below:

1) Surfactants: Polysorbate 80, 20 and Poloxamer 188

2) pH range from 5 to 8

3) Osmolyte: 5% sucrose

4) Salts: Sodium chloride (NaCl), potassium chloride (KCl), magnesium chloride ($MgCl_2$), ammonium sulfate ($NH_4SO_4$) and sodium sulfate ($Na_2SO_4$).

Based on the data from the initial liquid formulation screen it was determined that poloxamer 188 reduced aggregation of the target construct under shear stress, and that phosphate buffered saline (PBS) and NaCl at 150-200 mM also demonstrated increased stability.

Figure 21:
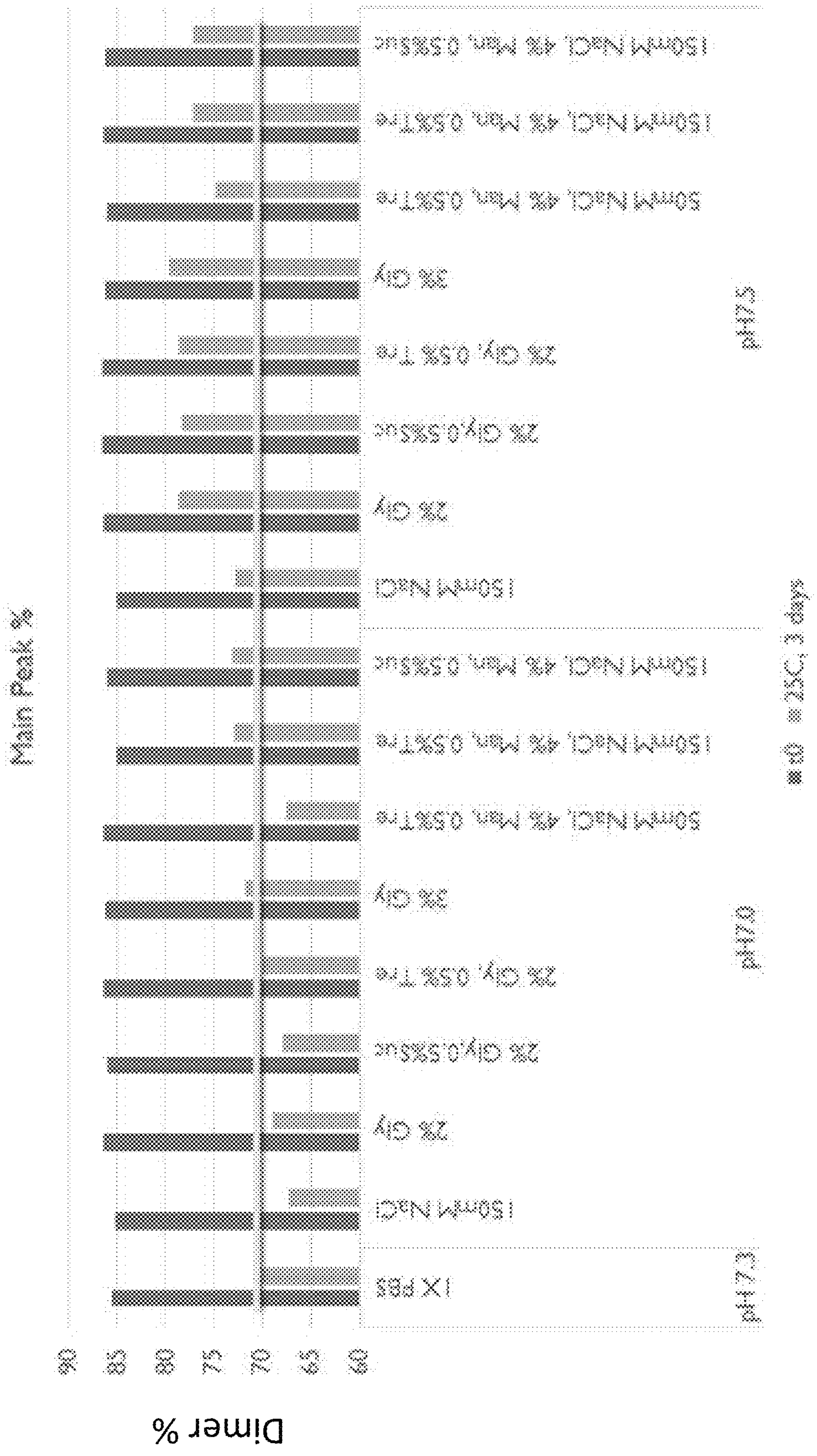
FIG. 21 illustrates percent of target constructs (SEQ ID NO: 5) in the dimer form in different lyophilization formulations before and after a 25° C. incubation. The horizontal line indicates the main peak dimer purity for the reference sample (1×PBS—no excipients) after 3 days at 25° C.
Figure 22:
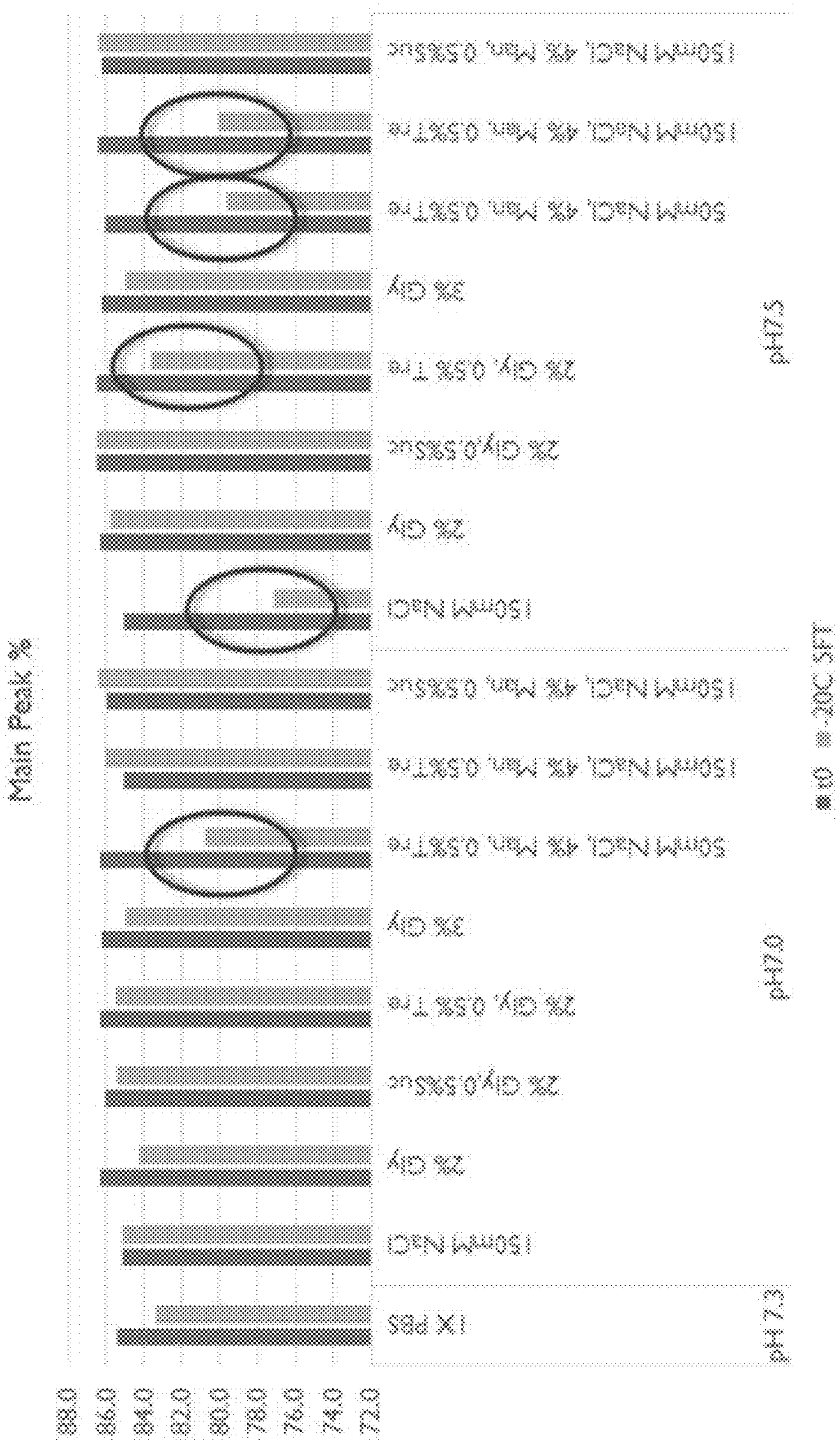
FIG. 22 illustrates percent of target constructs (SEQ ID NO: 5) in the dimer form in different lyophilization formulations before and after 5 freeze/thaw cycles (F/T) at −20° C.

Further testing based on the results from the initial liquid formulation screen, initial lyophilization feasibility studies were conducted using the conditions in TABLE 9. Glycine and mannitol, known to be useful in the lyophilization of proteins as amorphous bulking agents were added to this screen, histidine at pH 7.0 added to provide a more granular evaluation of the effect of pH in the 7.0-7.5 range, and trehalose was added as an option to sucrose as an osmolyte. FIGS. 21 and 22 show the percentage of target constructs in the dimer form before and after incubation at 25° C. for 3 days (FIG. 21) and before and after 5 freeze/thaw cycles (FIG. 22).

TABLE 9

| Summary of conditions used in initial lyophilization feasibility studies | | |
|---|---|---|
| Buffer | Bulking Agent | Stabilizer |
| 10 mM | — | 150 mM NaCl |
| Histidine | 2% Glycine | — |
| pH 7.0 | 2% Glycine | 0.5% Sucrose |
| | 2% Glycine | 0.5% Trehalose |
| | 3% Glycine | — |
| | 4% Glycine | 50 mM NaCl, 0.5% Trehalose |
| | 4% Glycine | 150 mM NaCl, 0.5% Trehalose |
| | 4% Glycine | 50 mM NaCl, 0.5% Sucrose |
| 10 mM | — | 150 mM NaCl |
| Sodium | 2% Glycine | — |
| Phosphate | 2% Glycine | 0.5% Sucrose |
| pH 7.5 | 2% Glycine | 0.5% Trehalose |
| | 3% Glycine | — |
| | 4% Mannitol | 50 mM NaCl, 0.5% Trehalose |
| | 4% Mannitol | 150 mM NaCl, 0.5% Trehalose |
| | 4% Mannitol | 50 mM NaCl, 0.5% Sucrose |

This initial lyophilization feasibility study demonstrated that the target construct was more stable at pH7.5 with sucrose and glycine with respect to reduced aggregation. Based on the results from this initial study a second lyophilization screen was conducted using the formulations listed in TABLE 10.

TABLE 10

| Summary of secondary formulation buffer screen | | | | | | | | | | |
|---|---|---|---|---|---|---|---|---|---|---|
| | Buffering | | | | Pre-Lyophilization (%) | | | Post-Lyophilization (%) | | |
| Buffer | Agent | Stabilizer | Surfactant | pH | HMW | Dimer | Monomer | HMW | Dimer | Monomer |
| | AMT-10 (Starting Material) | | | | 2.6 | 89.2 | 8.2 | | | |
| 10 mM Sodium Phosphate | 2% Glycine | 0.5% Sucrose | 0.3% Poloxamer | 7.5 | 2.9 | 89.8 | 7.4 | 4.3 | 89.3 | 6.4 |
| | | 1% Sucrose | | | 2.96 | 90.1 | 6.9 | 4.1 | 89 | 6.9 |
| | | 1% Trehalose | | | 2.9 | 90.3 | 6.8 | 3.6 | 89.8 | 6.6 |
| | 4% Mannitol | Sucrose, 1.3% arginine | | | 3.1 | 90.1 | 6.8 | 3.9 | 89.5 | 6.6 |
| | | 2.6% arginine | | | 4.9 | 86.7 | 8.4 | 4.1 | 89.5 | 6.4 |
| 10 mM Potassium | 2% Glycine | 1% Sucrose | | | 3.15 | 90.3 | 6.6 | 3.7 | 89.8 | 6.4 |
| | | 1% Trehalose | | | 3.2 | 90.1 | 6.7 | 3.9 | 89.5 | 6.6 |
| 10 mM Histidine | | 1% Sucrose | | 7 | 2.8 | 90.9 | 6.3 | 3.5 | 89.9 | 6.6 |
| | | 1% Trehalose | | | 2.95 | 90.5 | 6.6 | 3.3 | 90.2 | 6.5 |

From this screen, the two formulations that demonstrated the best stability were:

1) 10 mM potassium phosphate, 2% glycine, 1% sucrose or 1% trehalose, 0.3% poloxamer 188 at pH 7.5

2) 10 mM histidine, 2% glycine, 1% sucrose or 1% trehalose, 0.3% poloxamer at pH 7.0.

Using these two formulations, in order to ensure that the UF/DF step would function as intended and that freezing at the beginning of the lyophilization process would be acceptable, a final liquid formulation freeze/thaw screen and short-term stability study was conducted at higher protein concentrations as outlined in TABLE 11 below.

TABLE 11

| Formulations for freeze/thaw screening<br>Formulation |
|---|
| 10 mM Potassium Phosphate, 2% Glycine, 1% Sucrose, 0.3% Poloxamer 188, pH 7.5 |
| 10 mM Potassium Phosphate, 2% Glycine, 1% Trehalose, 0.3% Poloxamer 188, pH 7.5 |
| 10 mM Histidine, 2% Glycine, 1% Sucrose, 0.3% Poloxamer 188, pH 7.0 |
| 10 mM Histidine, 2% Glycine, 1% Trehalose, 0.3% Poloxamer 188, pH 7.0 |

Figure 23B:
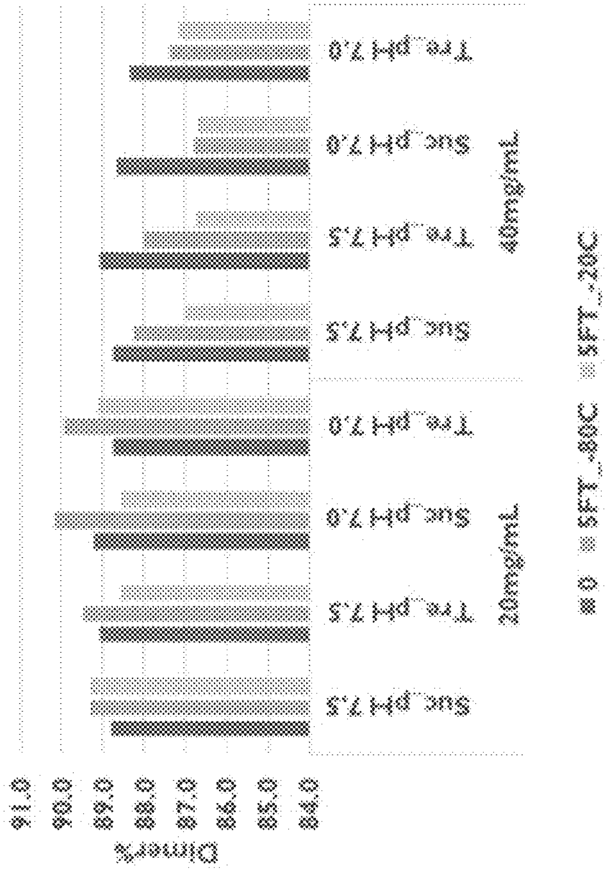
FIGS. 23A-23B illustrate the effect of 5 freeze/thaw cycles, at −20° C. and −80° C., on target constructs (SEQ ID NO: 5) aggregates and dimers.
Figure 23A:
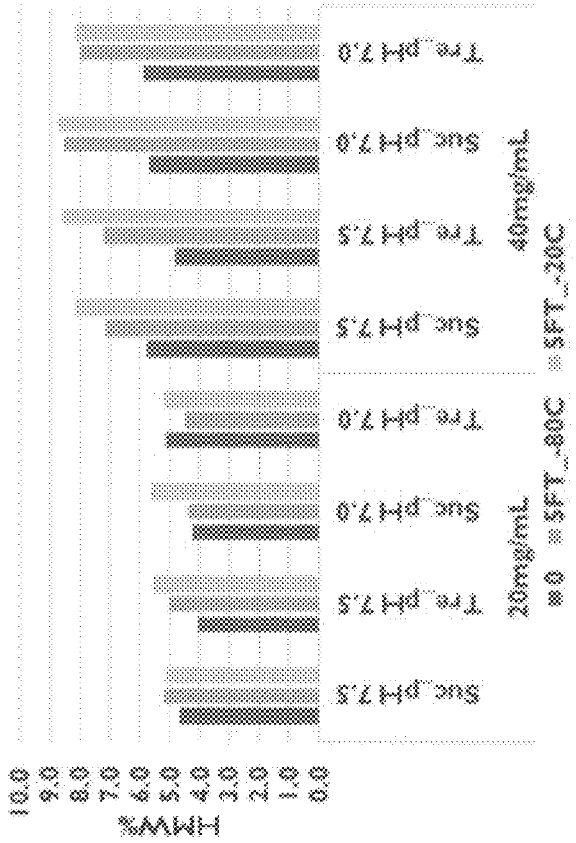
Figure 24A:
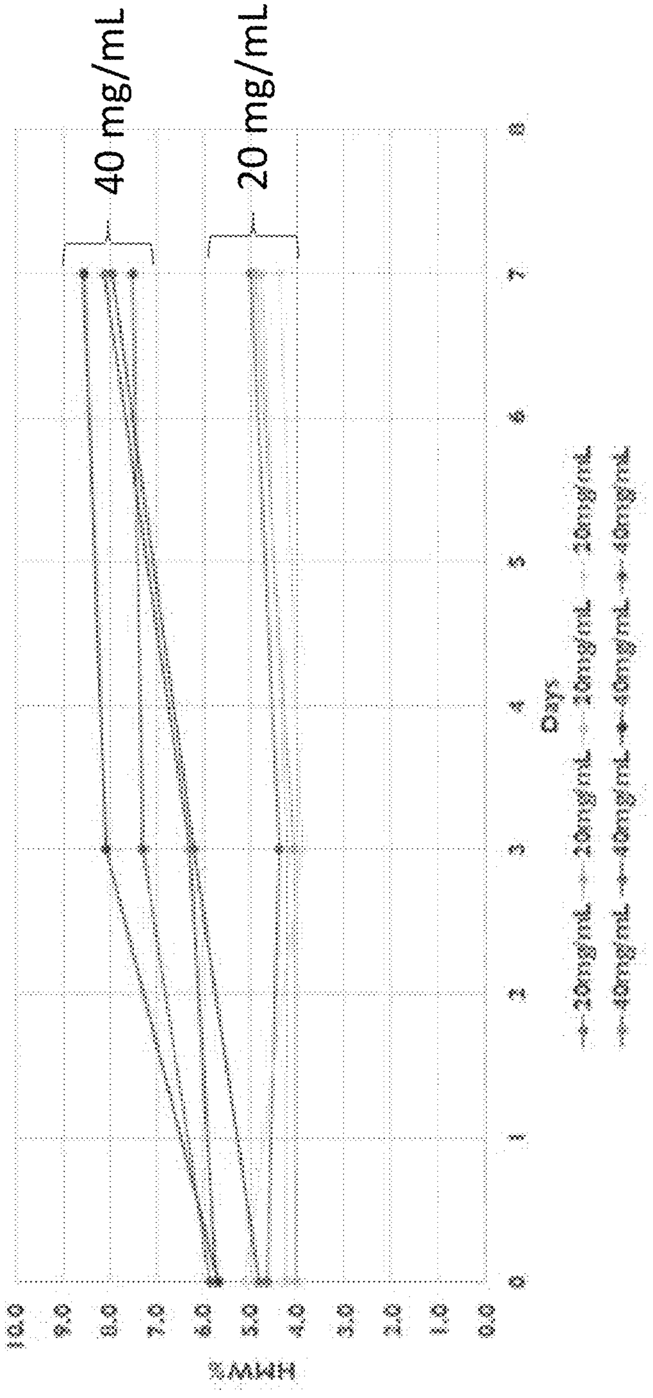
FIGS. 24A-24B illustrate the change in percent of target aggregates or dimers at 4° C. or 25° C. over a time course of one week in different formulations of lyophilization buffer from TABLE 11. Two different concentrations of target constructs (SEQ ID NO: 5) (20 mg/ml and 40 mg/ml) in the lyophilization buffers were examined for each of the four different formulations.
Figure 24B:
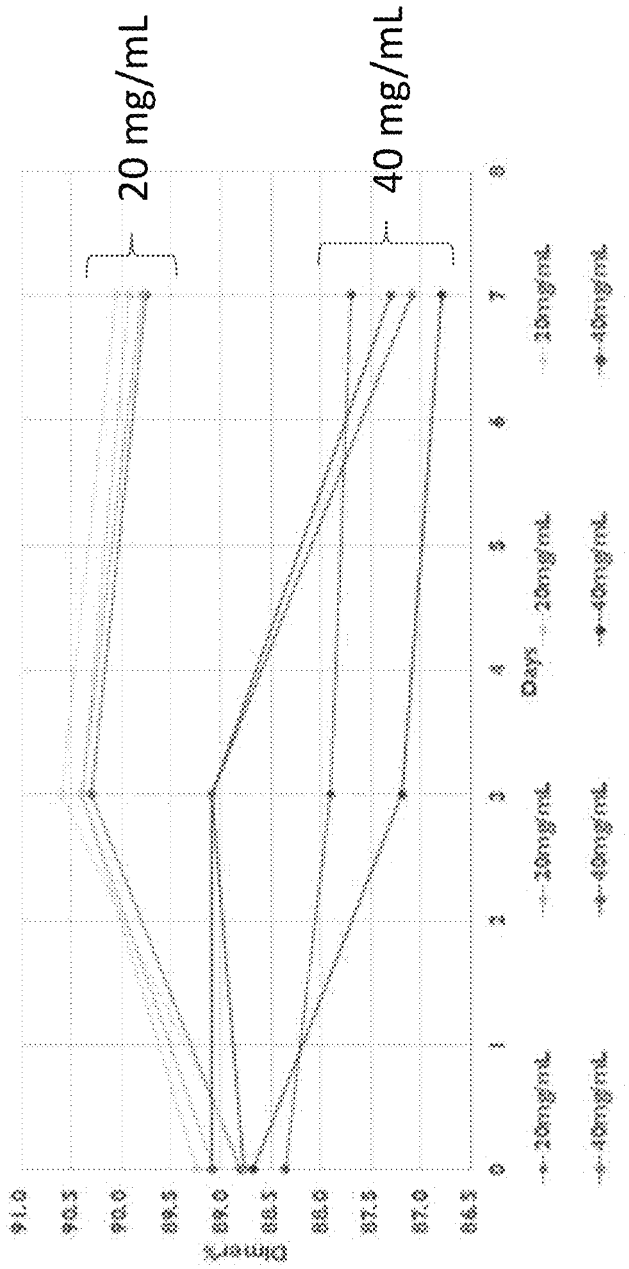
Figure 24C:
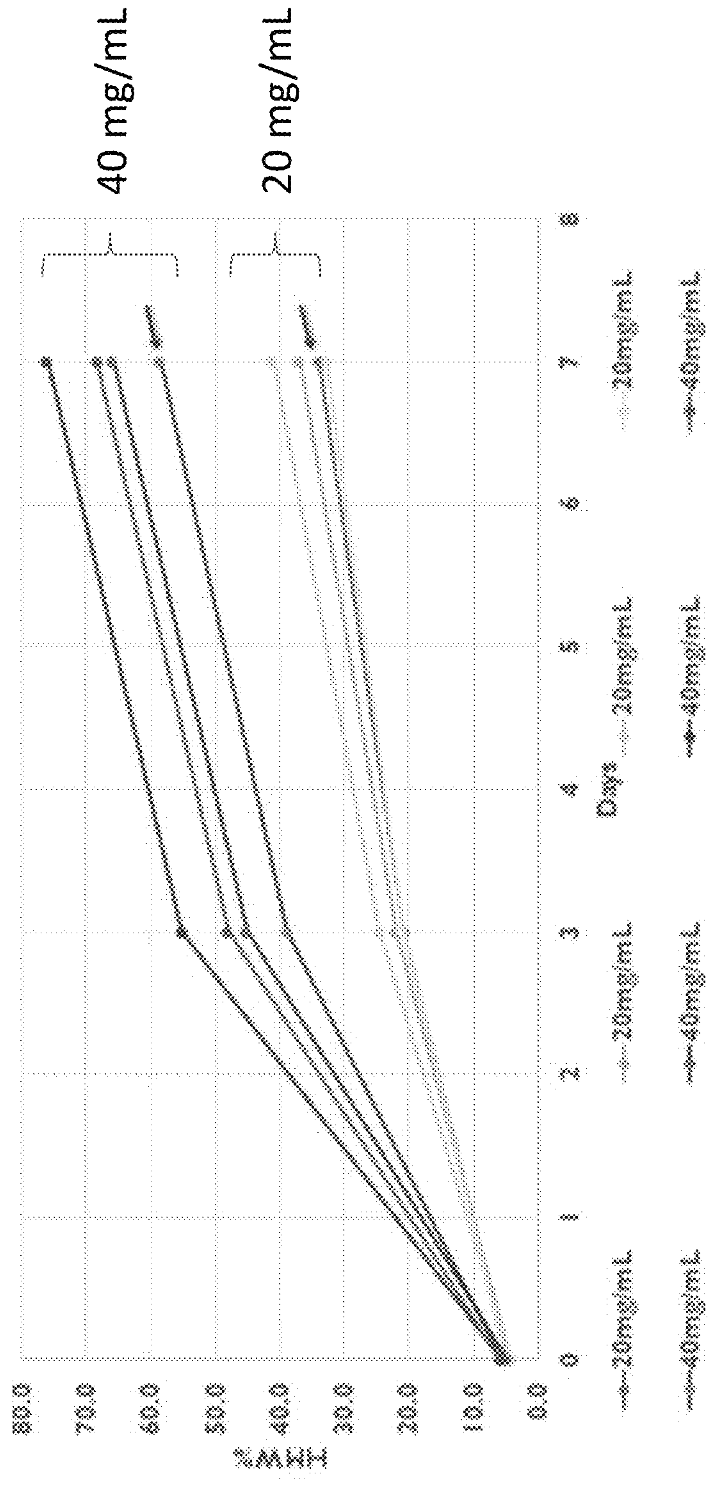
FIG. 24C illustrates the change in percent of target construct aggregates at 25° C. Arrows indicate the lyophilization buffer containing sucrose at pH 7.5.
Figure 24D:
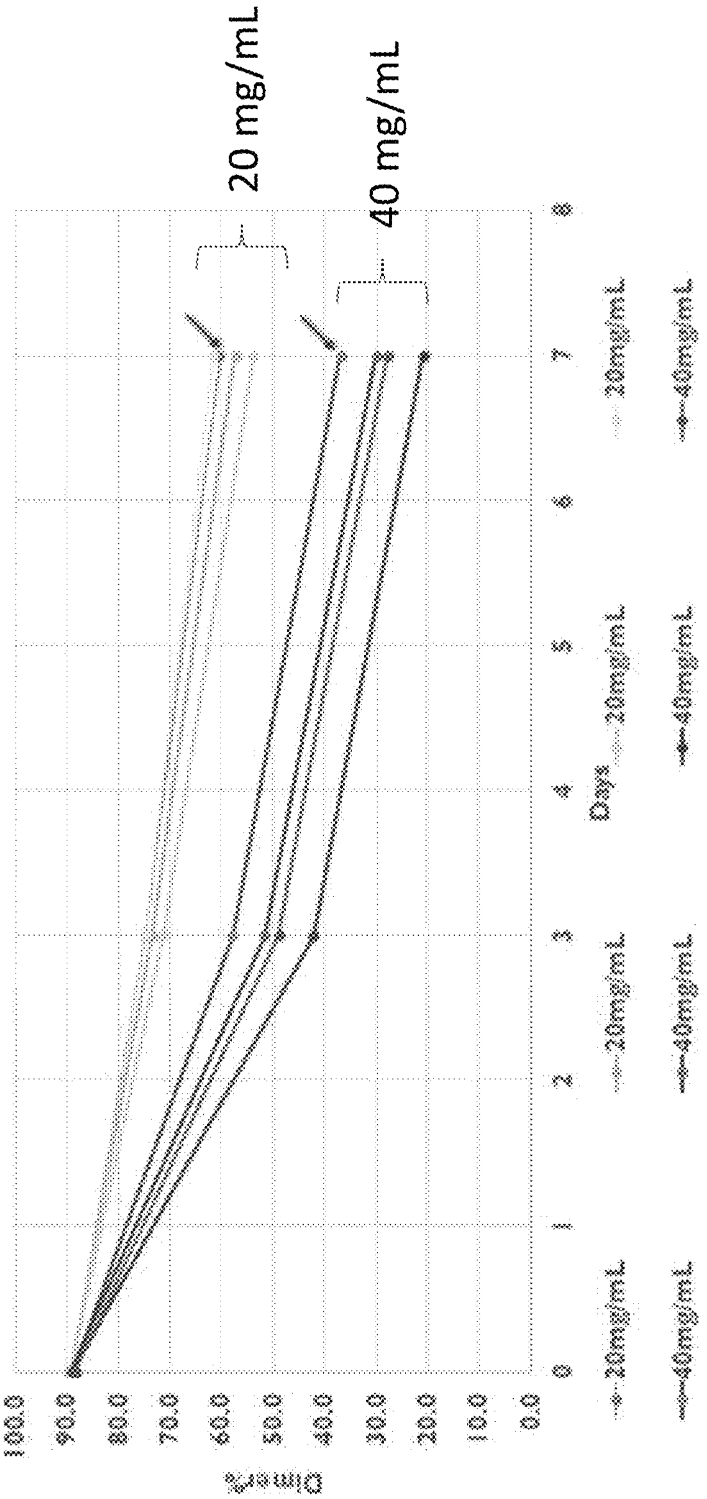
FIG. 24D illustrates the change in percent of target construct dimer at 25° C. Arrows indicate the lyophilization buffer containing sucrose at pH 7.5.

The target construct at a concentration of 20 mg/mL did not show any significant increases in aggregation during freeze/thaw or at 1 week at 4° C. for any condition tested. The formulation buffer consisting of 10 mM potassium phosphate, 2% glycine, 1% sucrose, 0.3% poloxamer 188 at a pH of 7.5 was determined to have the best overall stability at 2-8° C. and 25° C. over one week (see data in FIG. 24C and FIG. 24D, box and arrows highlighting the best formulation). This formulation was recommended to proceed as the buffer to be used in the UF/DF formulation step prior to lyophilization. Data from freeze/thaw experiments are shown in FIG. 23A and FIG. 23B. Data from a short-term stability study are shown in FIGS. 24A-24D.

Bulk lyophilization was carried out by thawing and dispensing the liquid intermediate into trays that were loaded into a lyophilizer. Control parameters during the lyophilization cycle such as temperature and vacuum pressure were executed based on time. In-process samples were taken after completion of the cycle. The lyophilized powder was pooled and mixed in a low-density polyethylene (LDPE) primary liner that was placed inside a secondary LDPE liner. The second liner was heat sealed, then placed into a mylar bag, which was also heat sealed. When lyophilized, the target construct resulted in a white to off-white powder. The combined lyophilized powder is the target construct drug substance (DS).

Example 6: In Vitro Evaluation of Coating Formulations

Different formulation types can be used to facilitate a targeted delivery of an active pharmaceutical ingredient (API) on its desired site of action and to protect the API against certain physiological conditions that are present in the gastrointestinal tract which could impact its stability. Upon ingestion, the API comes into contact with the low gastric pH and the proteolytic pepsin in the stomach which could influence its stability. Following passage through the stomach, the API enters the small intestine which is characterized by higher pH values. The secretion of bile salts and the proteolytic pancreatic enzymes can have a huge impact on the stability of the API. Furthermore, the gastric pH and concentrations of proteolytic enzymes vary considerably between the fed and fasted state. As such, the aim of this example was to investigate the disintegration of five different formulations and their subsequent targeted release of caffeine during passage through the complete gastrointestinal tract.

The reactor setup used in this experiment was adapted from the Simulator of the Human Intestinal Microbial Ecosystem (SHIME®), representing the gastrointestinal (GI) tract of the adult human, as described by Molly et al. (Appl Microbiol Biotechnol 39:254-258(1993)), which is herein incorporated by reference. In this system, the first two reactors simulated different steps in food uptake and digestion, with peristaltic pumps adding a defined amount of feed and pancreatic and bile liquid, respectively to the stomach and small intestine compartment and emptying the respective reactors after specified intervals. The last three compartments, continuously stirred reactors with constant volume and pH control, simulated the ascending, transverse, and descending colon. Retention time and pH of the different vessels are chosen in order to resemble in vivo conditions in the different parts of the GI tract.

Figure 3:
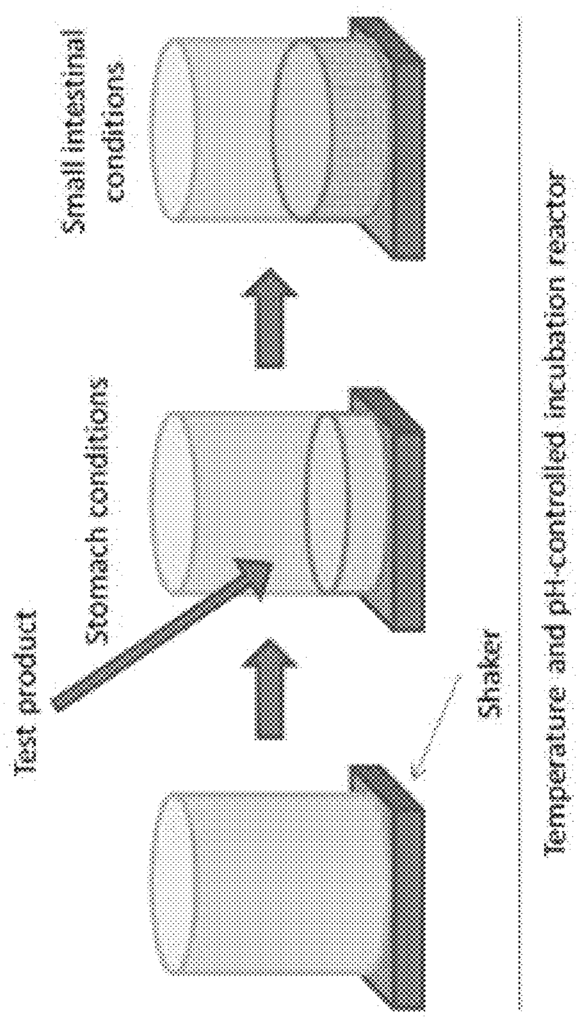
FIG. 3 illustrates an adapted SHIME® system simulating the physiological conditions of stomach, small intestine, and colon within the same reactor over time.
Figure 4:
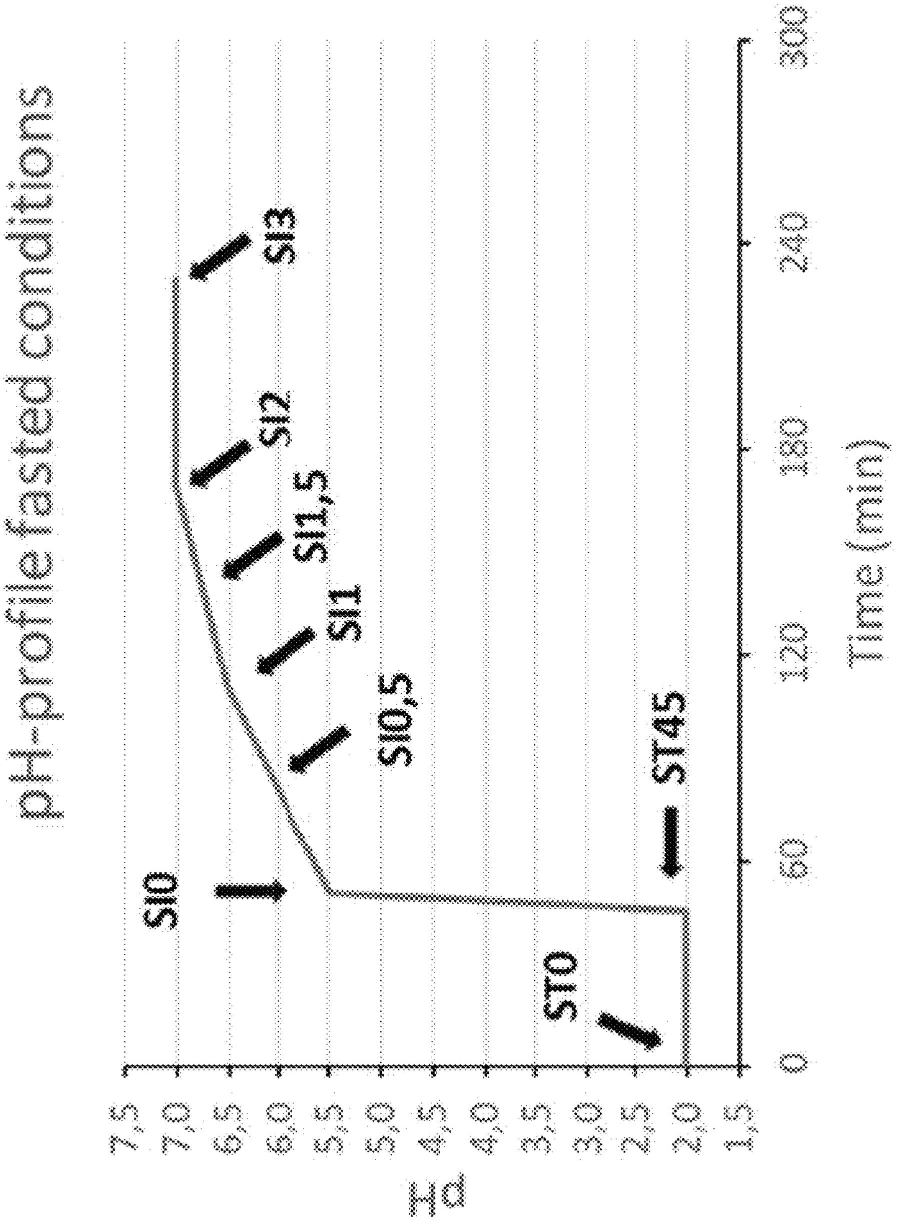
FIG. 4 illustrates a pH profile of a simulated GI tract under fasted conditions. Arrows indicate the time and corresponding pH of samples taken during the stomach incubation phase (ST0; ST45) and small intestine incubation phase (SI0; SI0.5; SI1; SI1.5; SI2; SI3).

In this experiment an adapted SHIME® system representing the physiological conditions of the stomach and small intestine within the same reactor over time was used (FIG. 3). In order to mimic fed or fasted conditions, a gastric suspension was added to the reactor. After this, a standardized enzyme and bile liquid was added to simulate the small intestinal condition. Incubation conditions (pH profiles, incubation times) were optimized in order to resemble in vivo conditions in the different regions of the gastrointestinal tract for fasted or fed conditions.

Protocol for Simulation of the Stomach and Small Intestines

During the study, the dissolution of capsules was tested during passage through the stomach and small intestines under fasted conditions.

In the gastric phase, the incubation occurred during 45 minutes at 37° C., while mixing via stirring, at pH 2.0 (FIG. 3). 4-fold lower pepsin and phosphatidylcholine levels were added relative to the fed conditions. As the background medium, only salts and mucins were supplied. Sampling and visual scoring at t=0 and 45 minutes of stomach incubation.

In the small intestinal phase, while mixing via stirring, the pH initially automatically increases from 2.0 to 5.5 within a period of 5 minutes after which the pH of the medium increased from 5.5 till 6.5 during the first hour, from 6.5 till 7.0 during the second hour, and remained constant at a value of 7.0 during the third hour of small intestinal incubation (FIG. 5). The temperature was controlled at 37° C. Regarding pancreatic enzymes, both a raw animal pancreatic extract (pancreatin) containing all the relevant enzymes in a specific ratio as well as defined ratios of the different enzymes was used. Under fasted conditions, 5-fold lower levels of the pancreatic enzymes were added as compared to experiments performed under fed conditions. Regarding bile salts, 3.3 mM bovine bile extract was generally supplemented as bovine bile is a closer match to human than porcine in terms of tauro- and glycocholate.

Protocol for Simulation of Colon

During this study, a fecal sample of one donor was harvested and stored at −80° C. until further use, as a source of colonic microbiotic for use during all colonic incubations that followed the passage through the upper GI tract. The use of the same colonic microbiotic hence allowed comparison of results obtained during the different experiments. After donation of the fecal sample in a sampling box, an Anaerogen bag was added and the box was immediately sealed. The powder in the Anaerogen bag immediately removed all oxygen from the sampling box. Subsequently, anaerobic PBS was added to the fecal sample and a fecal slurry was prepared by homogenization in a stomacher. The fecal slurry was briefly centrifuged to remove large particles. Afterwards, an equal volume of cryoprotectant solution was added to the fecal supernatant. After homogenization, the cryoprotected fecal slurry was snap-frozen in liquid nitrogen and stored at −80° C.

Before starting the actual colonic experiments, the cryopreserved fecal sample was pre-incubated in bioreactors in order to obtain a fully metabolically active colonic background microbiota that was used to inoculate the colonic incubations. Briefly, 2.5% (vol/vol) of fecal slurry was inoculated in a rich colonic medium containing both host- and diet-derived substrates. The vessels were made anaerobic through flushing with nitrogen gas and were incubated for 24 h at 37° C. As such, a fully established and metabolically active colonic microbiota was obtained after 24 h of incubation.

After taking the SIend (small intestine end or ileum) at the end of the stomach/small intestine experiments, the colonic incubations were initiated. This was done by adding 200 mL of fresh colonic medium, containing host- and diet-derived substrates, to the 200 mL of stomach/small intestine suspension. The simulation of a metabolically active luminal colonic microbiota was obtained by adding 300 mL of the pre-incubated fecal material to the bioreactors. The vessels were made anaerobic by flushing with nitrogen gas and were subsequently incubated for 18 h at 37° C. Visual scoring of the capsules and sampling of the reactors was performed after 0; 0.5; 1; 1.5; 2; 3; 4 h; and 18 h of colonic incubation.

Disintegration of Capsules

During transit in the simulated GI tract, a visual inspection of the capsules was conducted according to the following score: 1: capsule intact; 2: capsule damaged but almost all product is still in the capsule; 3: capsule damaged and all product was released; 4: capsule destroyed.

An HPLC-UV/Vis method was implemented that allowed to quantify the concentration of caffeine in the samples taken from the reactors. Briefly, the samples were run using an isocratic separation method (25% methanol: 75% water) on a C18 column. The column temperature was controlled at 25° C. The total run time per sample was 7 min. The injection volume was 10 μL and the UV/Vis detector was operated at 272 nm. Quantification of caffeine was performed using external standards. Prior to injection on the column, the samples were centrifuged for 15 min at 9000 rpm. Subsequently, the supernatant was filtered through a 0.2 μm filter into HPLC vials.

Statistically significant differences between the concentration of caffeine was determined in between each sampling point and its preceding one during the experiments under fasted conditions to demonstrate changes in function of time. In terms of statistics, the differences for all data discussed and indicated by "$p<0.05$" or "*" were significant with a confidence interval of 95%, as demonstrated using a Student's t-test.

The disintegration of five different formulation types during passage through the GI tract was investigated (TABLE 12). Next to the experiments with the five formulations a control experiment was performed to determine the concentration of caffeine in the background. To each reactor, one capsule was added and the capsules were mounted in a capsule sinker. All experiments were performed in biological triplicate.

TABLE 12

Formulations tested

Figure 5A:
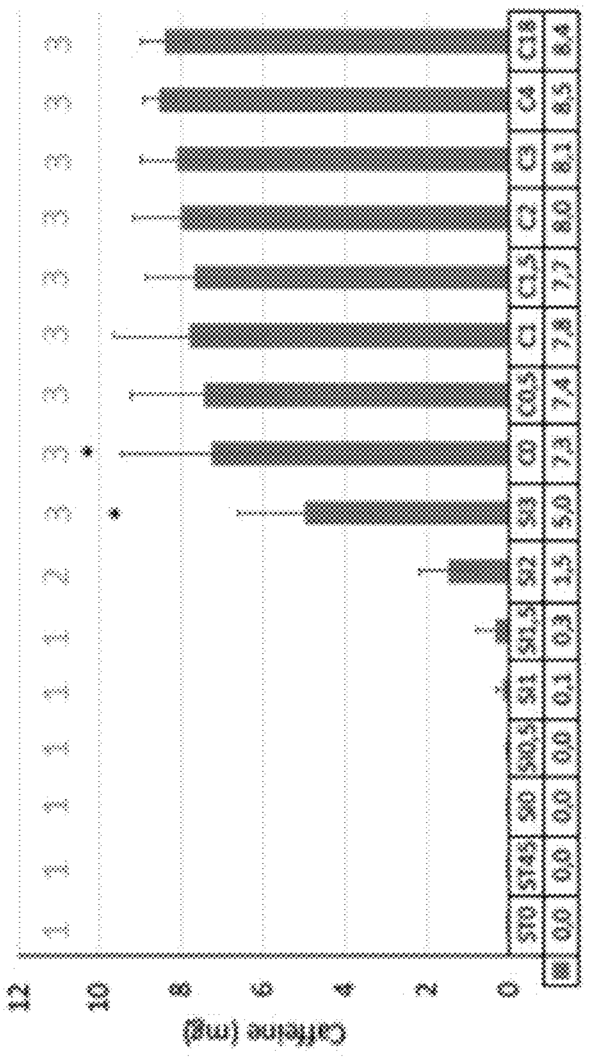
FIGS. 5A-5E illustrate average release of caffeine (mg) from size 1 capsules with various coating compositions and coating thickness, as shown by the capsule formulations in TABLE 12. Average release was determined from 3 individual capsules. Time points with conditions simulating the stomach are represented by ST0 and ST45. Time points with conditions simulating the small intestine are represented by SI0, SI0.5, SI1, SI1.5, S2, and S3. Time points with conditions simulating the colon are represented by C0, C0.5, CT, C1.5, C2, C3, C4, and C18.
Figure 5B:
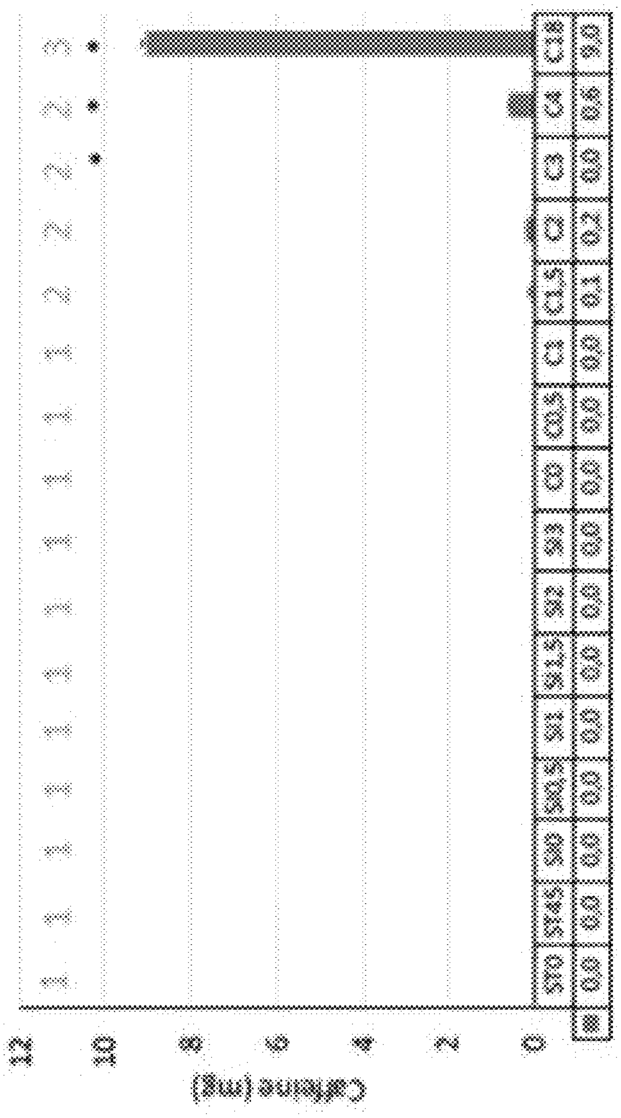
Figure 5C:
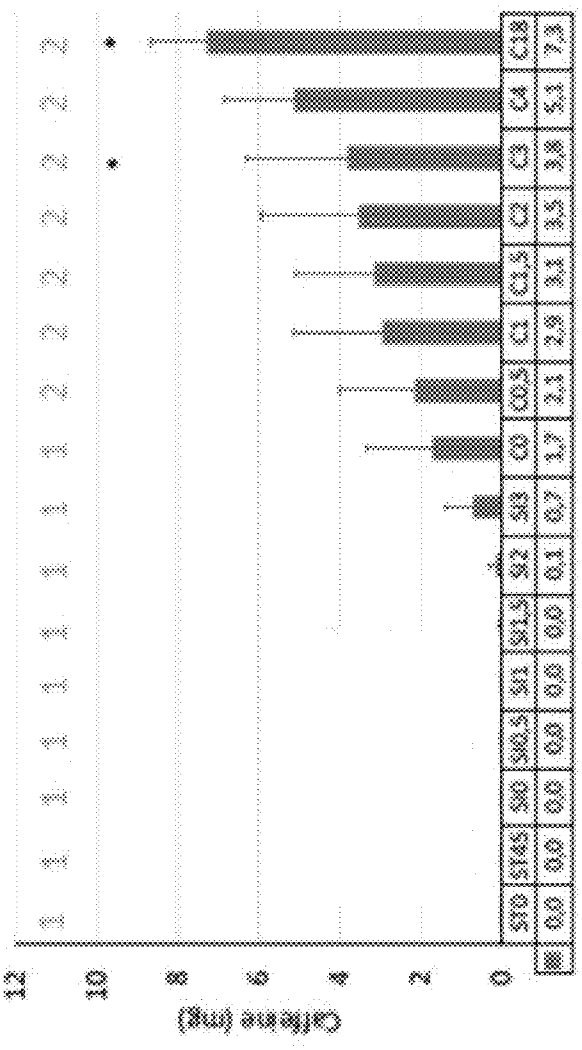

| Capsule Identity | Eudragit ® L30D55:Eudragit ® FS30D ratio | Capsule Contents | Coating Thickness | FIG. showing caffeine release profile |
|---|---|---|---|---|
| A | 50:50 | 20 mg SEQ ID NO: 5<br>10 mg caffeine | 60 mg | FIG. 5A |
| B | 50:50 | 20 mg SEQ ID NO: 5<br>10 mg caffeine | 128 mg | FIG. 5B |
| C | 20:80 | 10 mg rHSA<br>10 mg caffeine | 60 mg | FIG. 5C |

TABLE 12-continued

Figure 5D:
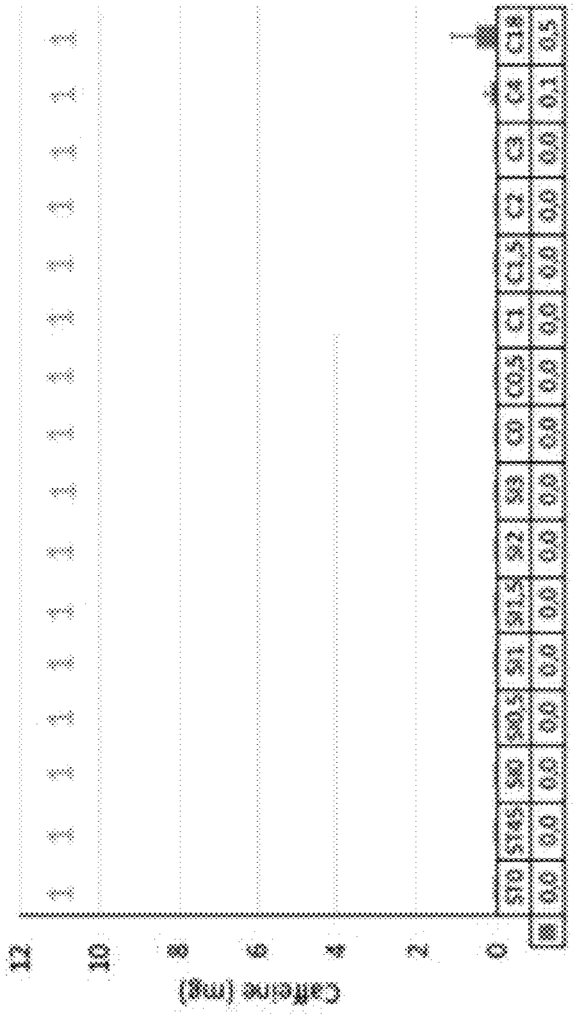
Figure 5E:
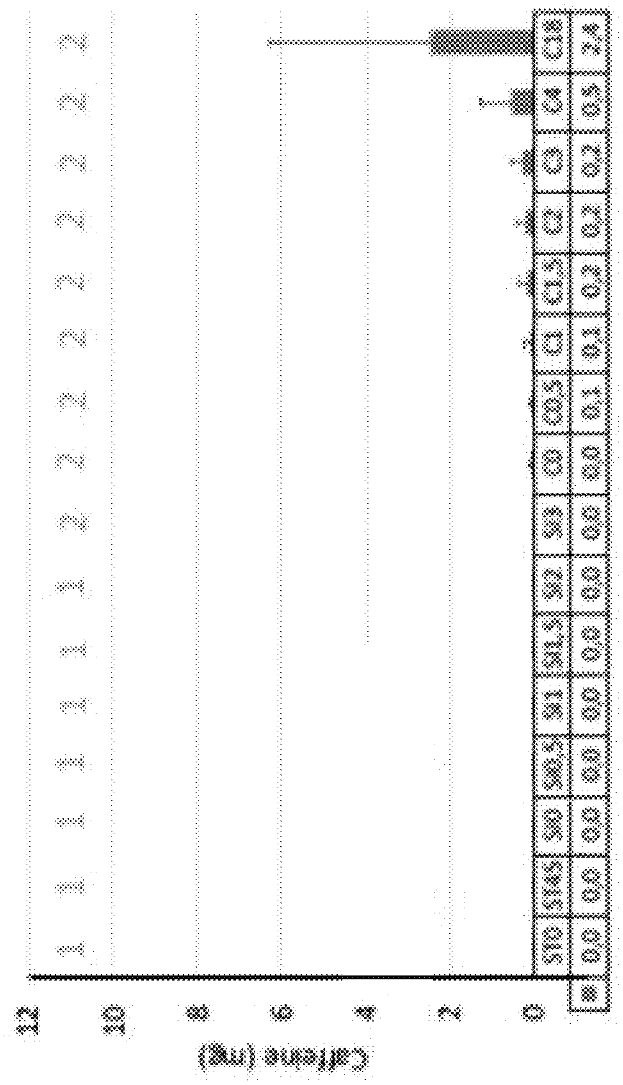

| Formulations tested | | | | |
|---|---|---|---|---|
| Capsule Identity | Eudragit ® L30D55:Eudragit ® FS30D ratio | Capsule Contents | Coating Thickness | FIG. showing caffeine release profile |
| D | 20:80 | 10 mg rHSA 10 mg caffeine | 120 mg | FIG. 5D |
| E | 0:100 | 10 mg rHSA 10 mg caffeine | 60 mg | FIG. 5E |

Determination of the concentration of caffeine present at the different sampling points during the control experiments revealed that this compound was not present in the stomach, small intestinal and colonic phase of the GI tract passage experiments. Hence, the background media used during the experiments with the five formulations could not generate interference with the detection of caffeine released from the capsules.

Capsule 1, having a coating thickness of 60 mg on a size 1 capsule and a Eudragit® ratio L30D55:FS30D of 50:50, remained completely intact during passage through the simulated fasted stomach, thereby protecting the API against the low pH conditions present during the stomach incubation phase. The capsules remained visually intact during the first hour of small intestinal incubation during which the pH of the medium increased from a value of 5.5 till 6.5. The capsules became damaged during the second hour of small intestinal incubation during which the pH increases from a value of 6.5 till a value of 7.0. FIG. 5A illustrates release of caffeine from Capsule 1.

Notwithstanding the visual damage to the capsule, the majority of the powder remained in the capsules as was demonstrated by the low amounts of caffeine measured after 2 hours of small intestinal incubation. The capsules became even more damaged during the third hour of small intestinal incubation (stable pH of 7.0) resulting in the release of a major part of the powder inside the capsules as was evident by the quantification of caffeine at this sampling point. During the colonic incubations the amount of caffeine remained fairly constant. A small increase was observed and this mainly due to the incomplete release of caffeine from the capsule during the experiments of replicate 2. The capsules were not completely destroyed at the end of the colonic incubation phase and visual inspection of the capsules revealed that a minor part of the powder was still present inside the capsules. This explains the reason why the total dose of 10 mg caffeine, which was present in the capsules, was almost fully released by the end of the colonic incubation. As such, it can be concluded that capsule 1 facilitates a targeted delivery of an API at the end-stages of the small intestinal incubation phase which corresponds with the terminal ileum of the gastrointestinal tract (GIT).

Capsule 2, having a coating thickness 128 mg on a size 1 capsule and an Eudragit® L30D55:FS30D ratio of 50:50, remained completely intact during passage through the fasted stomach (FIG. 5B).

Furthermore, as compared to capsule 1 (same Eudragit® ratio) the increased thickness of the coating of capsule 2 prevented the capsule to become damaged during passage through the small intestinal incubation phase where the pH of the medium increases from a value from 5.5 till 7.0.

Entrance of the capsule into the colonic environment resulted in visual damage to the capsules after 1.5 hours of incubation which resulted in a small release of caffeine after 4 hours of colonic incubation. Prolonged colonic incubation induced further damage to the capsules resulting in the release of high amounts of caffeine into the colonic lumen after 18 hours of colonic incubation. Throughout the colonic incubation phase the pH of the medium was controlled above a value of 5.8. As such, it can be concluded that the increased thickness of the coating of capsule 2 resulted in a delayed release of caffeine as compared to capsule 1. The capsules were not completely destroyed after the passage through the GI tract indicating that one of the polymers of the capsules did not dissolve at the pH values that were present during the GI tract passage. As such, it can be concluded that capsule 2 facilitates a targeted delivery of an API at the end-stages of the colonic incubation phase which corresponds with the distal colon of the GI tract.

Capsule 3, having a coating thickness of 60 mg on a size 1 capsule and an Eudragit® L30D55:FS30D of 20:80, remained completely intact during passage through the fasted stomach (FIG. 5C). Whereas the capsules did not become visually damaged during passage through the small intestine, small amounts of caffeine were detected after 3 hours of small intestinal incubation indicating the occurrence of undetectable microscopic damage to the capsules. The capsules became visually damaged after 0.5 hours of colonic incubation which resulted in increased amounts of caffeine being released from the capsules after 4 hours of colonic incubation. The amount of caffeine detected in the colonic medium further increased in between 4 h and 18 h of colonic incubation. The capsules did not become fully destroyed at the end of the passage through the full GI tract. As such, comparison of the data obtained during the experiments with capsule 1 and 3 indicated that increasing the percentage of FS30D at the cost of L30D55 resulted in the targeted delivery of the API at the start of the colonic incubation phase which corresponds to the proximal colon of the GI tract.

Capsule 4, having a coating thickness of 120 mg on a size 1 capsule and a Eudragit® L30D55:FS30D ratio of 20:80, remained visually intact throughout the passage of the complete GI tract (FIG. 5D). Only during the experiments of replicate 2 and 3, a minor amount of caffeine was detected. Hence, increasing the coating thickness and ratio of FS30D at the cost of L30D55 prevented the release of the API in the upper GI tract and proximal colon. It could be hypothesized that the content would only be released towards the distal colon upon longer incubation times at increasing pH.

Capsule 5, having a coating thickness of 60 mg on a size 1 capsule and a Eudragit® L30D55:FS30D ratio of 0:100, became visually damaged after 3 hours of small intestinal incubation when the pH of the small intestinal suspension was equal to 7 (FIG. 5E). However, nearly all powder remained trapped inside the capsule as was demonstrated by the absence of measurable amounts of caffeine at the end of the small intestinal incubation phase. Upon entering the colon, the capsules did not become further visually damaged. Only during the replicate 3 experimental run caffeine was detected at an adequate amount after 18 hours of colonic incubation. As such, it can be concluded that omitting L30D55 out of the capsule polymer mixture resulted in the absence of a targeted delivery of the API during passage through the upper GIT and proximal colon. It could be hypothesized that the content would only be released towards the distal colon upon longer incubation times at increasing pH.

Conclusion

During the present study, the disintegration of five different formulations during passage through the stomach, small intestine, and colon was evaluated. Dissolution of the capsules was studied through visual scoring at dedicated time points and through determination of the amount of caffeine released from the capsules during passage through the gastrointestinal tract (GIT).

All five formulations displayed different dissolution characteristics which were determined by their coating thickness and Eudragit® L30D55:FS30D ratio. The capsules of the present study with a coating thickness of 60 mg facilitated a targeted delivery of the API at the end of the small intestinal incubation or the beginning of the colonic incubation when their Eudragit® L30D55:FS30D ratio was 50:50 or 20:80, respectively. Increasing the coating thickness of capsules with an Eudragit® L30D55:FS30D ratio of 50:50 from 60 mg till 128 mg resulted in the targeted delivery of the API at the end stages of the proximal colonic incubations. Whereas capsules 1, 2, 3 were capable to provide a targeted delivery of the API, these capsules did not become completely dissolved at the end of the passage through the GIT resulting in the presence of capsule material at the end stages of the colonic incubations. Capsules 4 (coating thickness 120, Eudragit® L30D55:FS30D ratio of 20:80) and capsule 5 (coating thickness of 60 mg and Eudragit® L30D55:FS30D ratio of 0:100) did not disintegrate during passage through the upper GIT and proximal colon resulting in the absence of the targeted delivery of the API during the current experiment. It could be hypothesized that the content would only be released towards the distal colon upon longer incubation times at increasing pH.

Example 7: Evaluation of Enteric Coating

The composition of the enteric coat was selected based on experiments conducted on research batches of enterically coated capsules. The composition of these research batches is summarized in TABLE 13. Size 1 HPMC capsules were used for all batches. The fill weight of rHSA (recombinant human serum albumin) or the substance powder was approximately 30 mg as the protein content of each was approximately one third of the powder weight. Coating compositions comprised mixtures of Eudragit® L30D55 with a nominal dissolution pH of >5.5, and Eudragit® FS30D with a nominal dissolution pH of >7 (Evonik GmbH product information). Capsule release at a pH value of approximately 6.5 was desired to provide adequate enteric protection while allowing release of the target construct in the intestine.

TABLE 13

Composition of capsules for formulation development. All batches were filled to size 1 HPMC capsules.

| Eudragit coating composition (ratio of L30D55:FS30D) | Enteric coating target weight (mg) | Capsule contents |
|---|---|---|
| 50:50 | 60 | Caffeine (10 mg), rHSA (10 mg) |
| 30:70 | 120 | Caffeine (10 mg), IL-10 delivery |
| 20:80 | 180 | construct (SEQ ID NO: 5) |
| 0:100 | | (10 mg) |

Coating evaluation was conducted in two research studies with multiple batches of coated capsules.

For the first study, twelve batches of capsules containing caffeine and recombinant human serum albumin (rHSA) were prepared, comprising permutations of four different coating compositions and three different coating thicknesses. The coating compositions comprised ratios of Eudragit® L30D55 and Eudragit® FS30D, between 50:50 to 0:100 by weight.

Caffeine was included in this study as an easily-detected marker for capsule release. rHSA was considered to be a suitable surrogate protein for the target construct in this study as it was prepared as a lyophilized composition using the same lyophilization buffer as used for the target construct drug substance, at approximately the same protein content as the target construct drug substance, and the physical form of the lyophilized composition is comparable.

For the second study, three batches of capsules containing caffeine and the target construct were prepared, comprising three different coating thicknesses of a coating formulation containing equal amounts of Eudragit® L30D55 and Eudragit® FS30D.

Capsules from each research batch were placed in a stirred solution of 0.1 N HCl for at least 60 min, followed by transfer to buffer solutions at specified, higher pH values. These conditions were intended to simulate exposure to the acid environment of the stomach, followed by approximately neutral pH on passage to the intestines. In each experiment, the supernatant was periodically sampled and tested for the concentration of capsule contents which have been released from the capsule into solution.

Results of these experiments are summarized below. In no instance did any enterically coated capsule release contents during the 1 h incubation phase in 0.1 N HCl. Thus, data presented in the tables represents release during the buffer incubation phase only. As expected, enteric protection from acidic environment is demonstrated by all coatings evaluated.

First Study: Selection of Coat Composition

The composition of the enteric coat was selected from an initial study using capsules containing caffeine as a release marker and rHSA as a protein surrogate for the target construct. The ratio of Eudragit® L30D55 and Eudragit® FS30D varied between 50:50 to 0:100 to explore the effect of coating composition on capsule release as a function of solution pH.

TABLES 14-17 show the behavior of 12 sets of coated capsules containing caffeine and rHSA in pH7.0 buffer. Caffeine and rHSA values were normalized to 100% for capsules reaching maximum release, otherwise data was unadjusted. The release kinetics of caffeine and rHSA varied based on the weight and composition of capsule coating, although the release of both compounds was comparable for each individual capsule batch. Thus caffeine (a small molecule) and rHSA (a protein) provided similar information about capsule release under these conditions.

TABLE 14

Percent release of caffeine and rHSA from capsules coated with 50:50 ratio of Eudragit ® L30D55 and Eudragit ® FS30D, pH 7.0 Buffer

| Coating weight | Caffeine release at stated time | | | | | | rHSA release at stated time | | | | | |
|---|---|---|---|---|---|---|---|---|---|---|---|---|
| (mg) | 1 h | 2 h | 3 h | 4 h | 6 h | 8 h | 1 h | 2 h | 3 h | 4 h | 6 h | 8 h |
| 60 | 6 | 84 | 87 | 87 | 88 | 90 | 41 | 97 | 97 | 100 | 97 | 98 |
| 125 | 2 | 6 | 77 | 95 | 98 | 100 | 0 | 5 | 94 | 97 | 98 | 100 |
| 180 | 1 | 2 | 3 | 56 | 97 | 100 | 0 | 0 | 4 | 53 | 100 | 100 |

TABLE 15

| Percent release of caffeine and rHSA from capsules coated with 30:70 ratio of Eudragit ® L30D55 and Eudragit ® FS30D, pH 7.0 Buffer | | | | | | | | | | | | |
|---|---|---|---|---|---|---|---|---|---|---|---|---|
| Coating weight | Caffeine release at stated time | | | | | | rHSA release at stated time | | | | | |
| mg | 1 h | 2 h | 3 h | 4 h | 6 h | 8 h | 1 h | 2 h | 3 h | 4 h | 6 h | 8 h |
| 61 | 15 | 95 | 96 | 98 | 99 | 100 | 24 | 98 | 98 | 98 | 98 | 100 |
| 118 | 1 | 4 | 82 | 91 | 95 | 100 | 0 | 3 | 92 | 95 | 98 | 100 |
| 182 | 0 | 1 | 3 | 55 | 93 | 100 | 0 | 0 | 0 | 74 | 94 | 100 |

TABLE 16

| Percent release of caffeine and rHSA from capsules coated with 20:80 ratio of Eudragit ® L30D55 and Eudragit ® FS30D, pH 7.0 Buffer | | | | | | | | | | | | |
|---|---|---|---|---|---|---|---|---|---|---|---|---|
| Coating weight | Caffeine release at stated time | | | | | | rHSA release at stated time | | | | | |
| (mg) | 1 h | 2 h | 3 h | 4 h | 6 h | 8 h | 1 h | 2 h | 3 h | 4 h | 6 h | 8 h |
| 56 | 5 | 87 | 97 | 97 | 100 | 98 | 7 | 96 | 98 | 97 | 99 | 100 |
| 120 | 1 | 2 | 7 | 78 | 95 | 100 | 0 | 0 | 2 | 89 | 98 | 100 |
| 177 | 1 | 1 | 1 | 5 | 56 | 100 | 0 | 0 | 0 | 2 | 87 | 100 |

TABLE 17

| Percent release of caffeine and rHSA from capsules coated with 0:100 ratio of Eudragit ® L30D55 and Eudragit ® FS30D, pH 7.0 Buffer | | | | | | | | | | | | |
|---|---|---|---|---|---|---|---|---|---|---|---|---|
| Coating weight | Caffeine release at stated time | | | | | | rHSA release at stated time | | | | | |
| (mg) | 1 h | 2 h | 3 h | 4 h | 6 h | 8 h | 1 h | 2 h | 3 h | 4 h | 6 h | 8 h |
| 59 | 1 | 19 | 93 | 97 | 99 | 100 | 0 | 50 | 97 | 98 | 98 | 100 |
| 120 | 1 | 1 | 3 | 23 | 83 | 100 | 0 | 0 | 0 | 0 | 94 | 100 |
| 181 | 1 | 2 | 2 | ND | 2 | 18 | 0 | 0 | 0 | 0 | 0 | 45 |

For these capsule batches, greater total weight of enteric coat correlated with a slower onset of release of caffeine and rHSA in pH 7.0 buffer, and longer time to achieve complete release. Less significant correlation was seen between release in pH 7.0 buffer and the coating composition. Almost all capsules released their contents completely in pH 7.0 buffer over the course of testing, with the exception that capsules coated with 100:0 ratio of FS30D to L30D55 showed delayed onset of release and incomplete release for greater coating weights.

TABLES 18-19 summarize the behavior of the same capsules in pH 6.5 and pH 6.0 buffers. Only rHSA values are presented, as the kinetics of caffeine release and rHSA were again comparable for each capsule. rHSA values were normalized to 100% for capsules reaching maximum release, otherwise data was unadjusted. Coat weight shown in TABLES 18-19 was the target coating weight, but actual coating weight varied by not more than 5 mg from the target coating weight.

TABLE 18

| Release of rHSA from capsules coated with different ratios of Eudragit ® L30D55 and Eudragit ® FS30D, pH 6.5 Buffer | | | | | | | | | | | | | | | | | | |
|---|---|---|---|---|---|---|---|---|---|---|---|---|---|---|---|---|---|---|
| | Release of rHSA from Capsules of Stated Coating Composition at Stated Time<br>Coating Composition | | | | | | | | | | | | | | | | | |
| Coating | 50:50 FS30D/ L30D55 | | | | | | 70:50 FS30D/ L30D55 | | | | | | 80:50 FS30D/ L30D55 | | | | | |
| weight (mg) | 1 h | 2 h | 3 h | 4 h | 6 h | 8 h | 1 h | 2 h | 3 h | 4 h | 6 h | 8 h | 1 h | 2 h | 3 h | 4 h | 6 h | 8 h |
| 60 | 11 | 93 | 96 | 98 | 99 | 100 | 8 | 78 | 95 | 97 | 98 | 100 | 0 | 17 | 64 | 77 | 82 | 92 |
| 120 | 0 | 2 | 13 | 94 | 98 | 100 | 0 | 7 | 36 | 64 | 92 | 100 | 0 | 0 | 0 | 0 | 12 | 42 |
| 180 | 0 | 0 | 2 | 3 | 94 | 100 | 0 | 0 | 0 | 4 | 43 | 85 | 0 | 0 | 0 | 0 | 1 | 10 |

TABLE 19

| Coating weight (mg) | 50:50 FS30D/L30D55 1 h | 2 h | 3 h | 4 h | 6 h | 8 h | 70:30 FS30D/L30D55 1 h | 2 h | 3 h | 4 h | 6 h | 8 h | 80:20 FS30D/L30D55 1 h | 2 h | 3 h | 4 h | 6 h | 8 h |
|---|---|---|---|---|---|---|---|---|---|---|---|---|---|---|---|---|---|---|
| 60 | 12 | 79 | 97 | 98 | 100 | 100 | 4 | 30 | 43 | 58 | 62 | 67 | 0 | 0 | 29 | 39 | 52 | 100 |
| 120 | 0 | 6 | 21 | 23 | 83 | 98 | 0 | 0 | 0 | 0 | 39 | 72 | 0 | 0 | 0 | 0 | 0 | 0 |
| 180 | 0 | 0 | 0 | 0 | 6 | 30 | 0 | 0 | 0 | 0 | 0 | 3 | 0 | 0 | 0 | 0 | 0 | 0 |

Release of rHSA from capsules coated with different ratios of Eudragit ® L30D55 and Eudragit ® FS30D, pH 6.0 Buffer. Release of rHSA from Capsules of Stated Coating Composition at Stated Time; Coating Composition.

In either buffer condition, a clear trend in release kinetics with respect to coating weight was observed whereby increased total weight of enteric coat correlated with a slower onset of release of rHSA, and longer time to achieve complete release. At pH 6.5 and pH 6.0, a trend in coating composition was also evident. Coatings containing a higher proportion of Eudragit® FS30D showed delayed onset of release with lower buffer pH, and incomplete or no release was observed for greater coating weights in these cases. No release was observed for any capsule coated with 100:0 ratio of FS30D to L30D55 under these conditions at pH 6.5 or 6.0.

Thus, the release of rHSA was dependent on both the weight and composition of the enteric coat. A coating weight of 60 mg with a 50:50 composition of Eudragit® L30D55 and Eudragit® FS30D provided the most rapid release of capsules tested under these conditions.

Second Study: Selection of Coat Weight

Evaluation of the coating weight was continued in a second study with capsules containing target constructs.

TABLES 20-22 show the behavior of three batches of capsules containing caffeine and target constructs, with different coating weight of 50:50 Eudragit® polymers L30D55 and FS30D. The release of caffeine and target constructs in buffers at pH 7.0, pH 6.5, and pH 6.0 was examined. These capsules were subjected to prior incubation in 0.1 N HCl for 1 h, and no release of caffeine or target construct was detected in any instance. Caffeine and target construct values were normalized to 100% for capsules reaching maximum release, otherwise data was unadjusted. ND indicates data point could not be determined due to sample loss.

TABLE 20

Release of caffeine and target constructs from capsules coated with 50:50 ratio of Eudragit ® L30D55 and Eudragit ® FS30D, pH 7.0 Buffer

| Coating weight (mg) | Caffeine release at stated time 1 h | 2 h | 3 h | 4 h | 6 h | 8 h | AMT-101 release at stated time 1 h | 2 h | 3 h | 4 h | 6 h | 8 h |
|---|---|---|---|---|---|---|---|---|---|---|---|---|
| 60 | 13 | 100 | 97 | 97 | 98 | 100 | 8 | 81 | 81 | 81 | 78 | 75 |
| 128 | 0 | 3 | 60 | 95 | 98 | 100 | 0 | 0 | 60 | 81 | 81 | ND |
| 178 | 0 | 1 | 3 | 5 | 76 | 100 | 0 | 0 | 6 | 6 | 45 | 39 |

TABLE 21

Release of caffeine and target constructs from capsules coated with 50:50 ratio of Eudragit ®L30D55 and Eudragit ®FS30D, pH 6.5 Buffer

| Coating weight (mg) | Caffeine release at stated time 1 h | 2 h | 3 h | 4 h | 6 h | 8 h | AMT-101 release at stated time 1 h | 2 h | 3 h | 4 h | 6 h | 8 h |
|---|---|---|---|---|---|---|---|---|---|---|---|---|
| 60 | 5 | 22 | 97 | 98 | 98 | 100 | 0 | 60 | 72 | 72 | 73 | 70 |
| 128 | 0 | 1 | 6 | 36 | 81 | 100 | 0 | 0 | 0 | 32 | 41 | 39 |
| 178 | 0 | 0 | 0 | 2 | 11 | 37 | 0 | 0 | 0 | 0 | 0 | 5 |

TABLE 22

Release of caffeine and target constructs from capsules coated with 50:50 ratio of Eudragit ®L30D55 and Eudragit ®FS30D, pH 6.0 Buffer

| Coating weight (mg) | Caffeine release at stated time 1 h | 2 h | 3 h | 4 h | 6 h | 8 h | AMT-101 release at stated time 1 h | 2 h | 3 h | 4 h | 6 h | 8 h |
|---|---|---|---|---|---|---|---|---|---|---|---|---|
| 60 | 3 | 16 | 56 | 88 | 98 | 100 | 7 | 13 | 18 | 18 | 17 | 17 |
| 128 | 0 | 0 | 3 | 8 | 51 | 88 | 0 | 0 | 0 | 0 | 6 | 6 |
| 178 | 0 | 0 | 0 | 2 | 11 | 34 | 0 | 0 | 0 | 0 | 0 | 0 |

The time to onset of release of caffeine and target constructs were comparable for each capsule. As seen earlier for the rHSA capsules, a clear trend in release kinetics with respect to coating weight was observed whereby increased total weight of the enteric coat correlates with a later onset of release of caffeine and target constructs, and longer time to achieve complete release. In general, release of target constructs reached concentrations which were lower than calculated based on the capsule fill weight. Higher concentrations of target constructs were generally achieved for capsules with an earlier time of onset of release. The reason for lower than expected release of target constructs will be investigated in future studies. At this early stage in development, fast-releasing coating compositions were selected to minimize potential loss of target constructs during capsule release.

Selection of Enteric Coat

Based on the research capsule studies, a coating composition comprising 50:50 mixture of Eudragit® polymers L30D55 and FS30D was selected for the clinical capsule presentation. A target coating weight of 60 mg on Size 1 capsule was selected to provide enteric protection from stomach acid, but release capsule contents on reaching a neutral pH environment. Coating weight of 60 mg on a Size 1 capsule provides equivalent coat thickness to coating of 75 mg for a Size 0 capsule selected for clinical presentation.

Example 8: In Vitro Dissolution Data

Eight capsule coating formulations (Formulations A-H in TABLE 23) were tested for in vitro dissolution rates at varying pHs. The first hour was an acid stage where the capsule was exposed to a dissolution media containing 0.1 M hydrochloric acid at a pH of 1.0. The remaining hours were spent in a buffer stage where the capsule was exposed to a dissolution media containing a citrate/phosphate buffer at pH of 7.0, 6.5, or 6.0. Each capsule was removed using a plastic spatula while changing the media. Capsules were placed inside a 150 mL glass beaker with a stir bar stirring at 100 rpm and a heater set up at 37° C. The percent release of caffeine was determined by measuring UV absorbance. The percent release of the IL-10 delivery construct was determined by size exclusion chromatography (SEC) (TABLE 24) and the dimer form was detected as a single peak. Recorded values were determined from a standard curve of the respective analyte. During SE-HPLC, multi-angle light scattering (MALS) detection in combination with UV absorbance and refractive index (RI) detection is used to determine the molecular mass of the eluted peaks. Detection was performed by absorbance at 280 nm.

Eudgragit-coated capsules were subject to 1 hour of acid stage dissolution and then buffer stage dissolution. Capsule without a Eudragit coat (HPMC coat only) were test in the buffer stage only. Dissolution media was stirred at 100 rpm for the entire duration of the assay. 500 µL aliquots of samples were collected at the end of the acid stage, 1 h, 2 h, 3 h, 4 h, 6 h, and 24 h of the buffer stage into 0.22 µm cellulose acetate Spin-X centrifuge tube filters (Costar Cat #8161). Centrifugation was done at 15,000×g for 2 min. 150 µL aliquots of samples were then transferred into HPLC vials and analyzed by first SEC and then RP chromatography.

TABLE 23

Formulation of capsules examined for in vitro dissolution of capsule contents

| Formulation Identifier | Target construct amount (mg) per capsule | Caffeine amount (mg) per capsule | BPMC Capsule Coat (mg) | Eudragit ® Composition (L30D55/ FS30D) | Eudragit ® Coat Weight gain | Description |
|---|---|---|---|---|---|---|
| A | 10 | 10 | 10 | 50/50 | 60 | Reference composition |
| B | 10 | 10 | 10 | 50/50 | 30 | Thin Eudragit ® 50/50 |
| C | 10 | 10 | 10 | 30/70 | 30 | Thin Eudragit ® 30/70 |
| D | 10 | 10 | 10 | 30/70 | 60 | Standard 30/70 |
| E | 10 | 10 | 10 | 30/70 | 90 | Standard 30/70 |
| F | 10 | 10 | 10 | 30/70 | 120 | Thick 30/70 |
| G | 10 | 10 | 60 | 50/50 | 30 | Increase HPMC |
| H | 10 | 10 | 180 | 50/50 | 30 | Thick HPMC |

TABLE 24

SE-HPLC Method

| | |
|---|---|
| System | Vanquish UHPLC system with PDA Detector |
| Column | Waters ACQUITY UPLC Protein BEH SEC 200 Å 1.7 µm, 4.6 × 150 mm Part No: 186005225 |
| Column Temperature | 25° C. |
| Autosampler Temperature | 4° C. |

TABLE 24-continued

SE-HPLC Method

| | |
|---|---|
| Mobile Phase | 100 mM Sodium Phosphate, 150 mM Sodium Chloride, pH 7.0 ± 0.1 |
| Separation mode | Isocratic |
| Flow Rate | 0.3 mL/min |
| Total Runtime | 10 min |
| Detection Wavelengths | 215 nm, 280 nm |
| Injection Volume | 100 µL (or vary) |

Figure 6A:
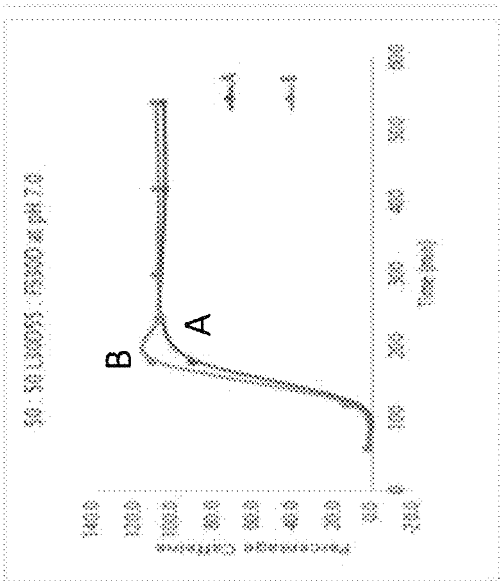
FIGS. 6A-6C illustrate percent caffeine release from various capsule coatings, the first hour at pH 1.0 and the remaining time at pH 7.0.
Figure 6B:
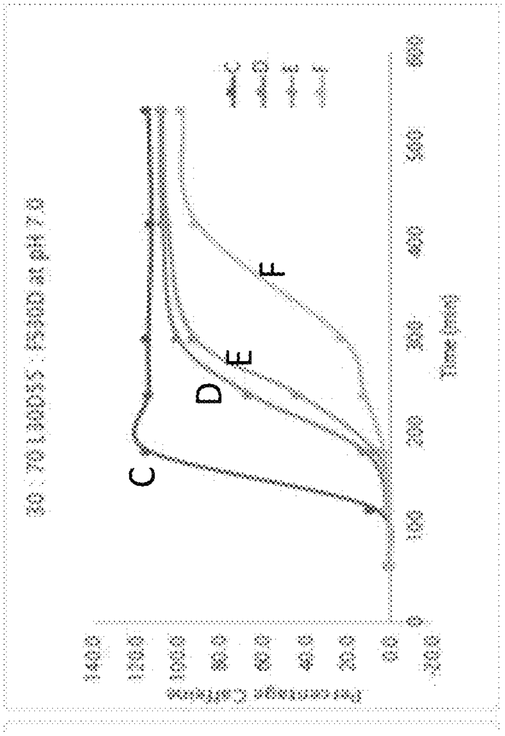
Figure 6C:
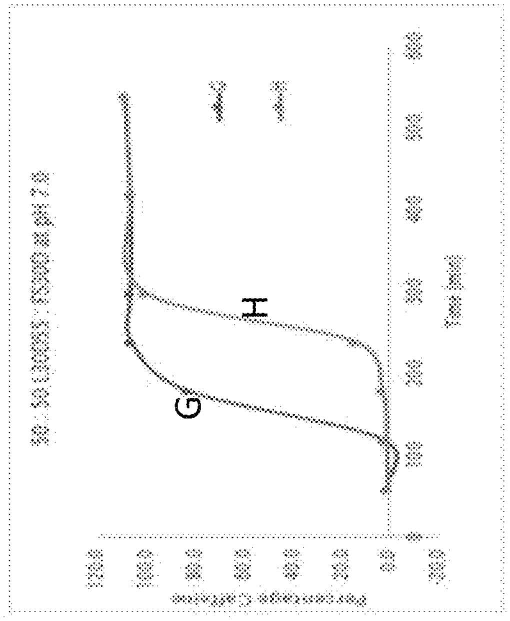
Figure 7A:
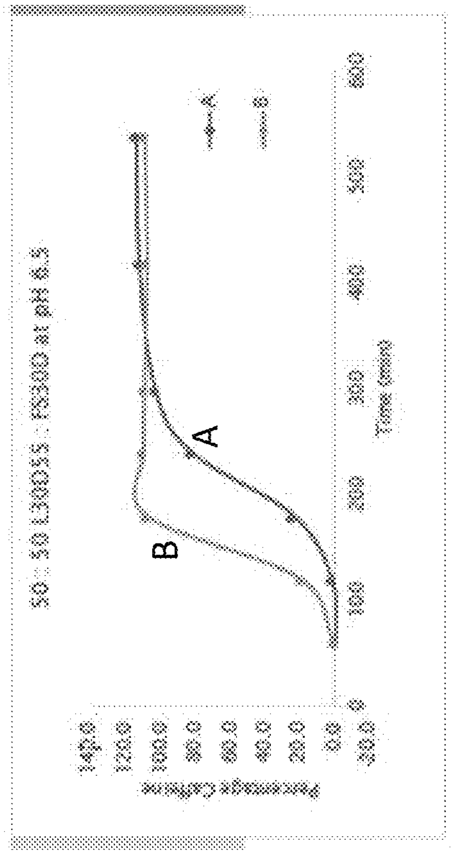
FIGS. 7A-7C illustrate percent caffeine release from various capsule coatings, the first hour at pH 1.0 and the remaining time at pH 6.5.
Figure 7B:
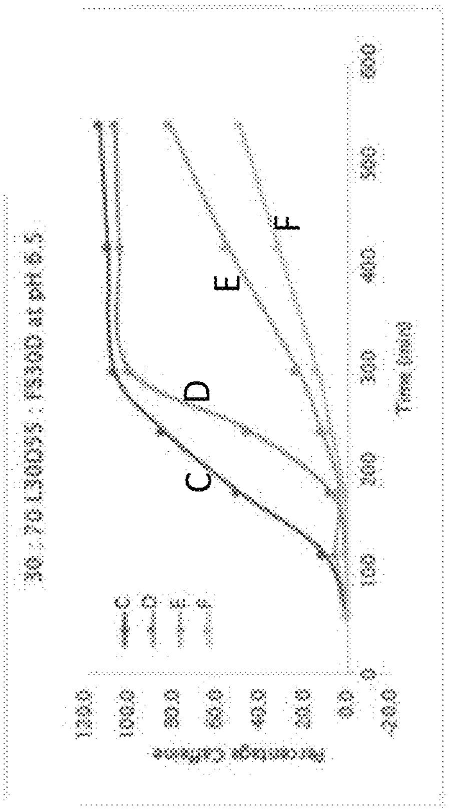
Figure 7C:
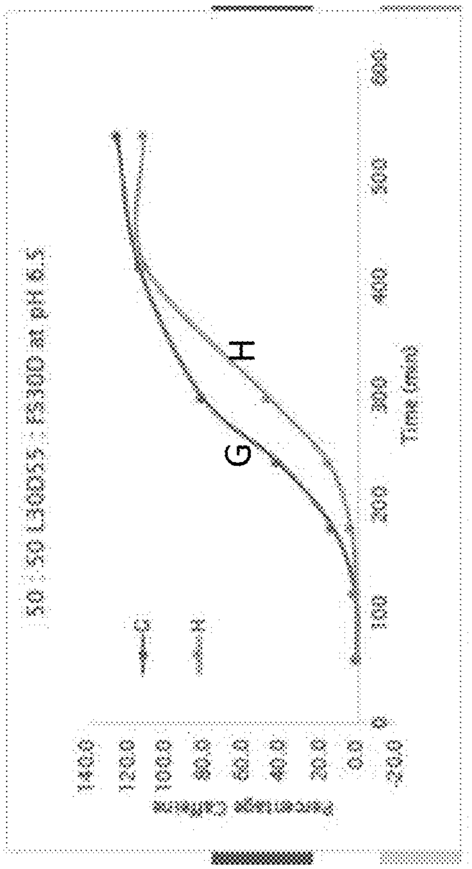
Figure 8A:
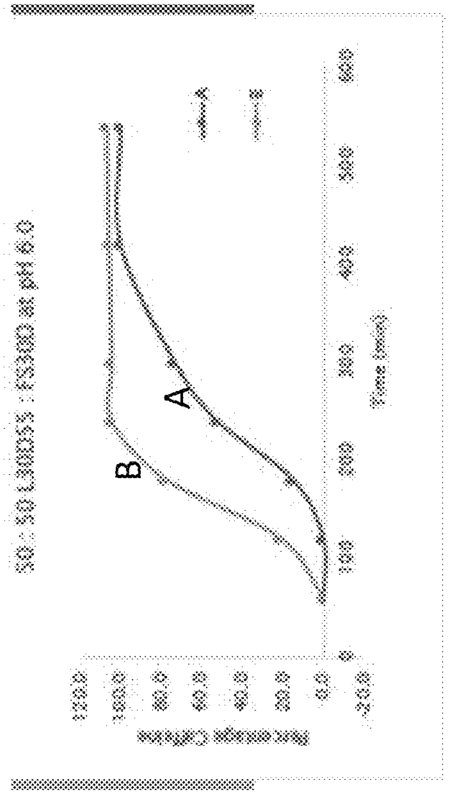
FIGS. 8A-8C illustrate percent caffeine release from various capsule coatings, the first hour at pH 1.0 and the remaining time at pH 6.0.
Figure 8B:
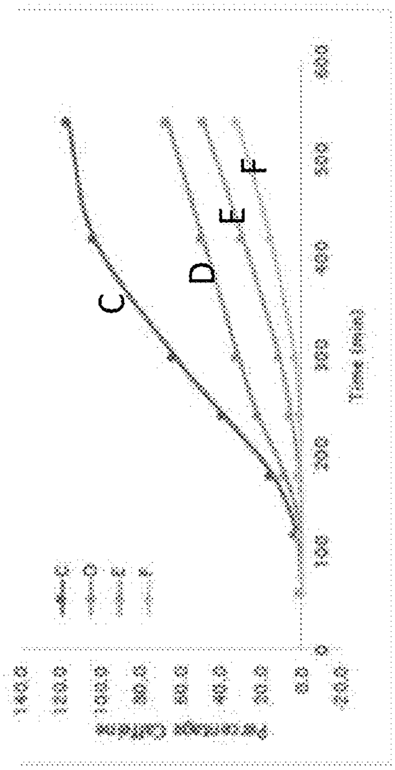
Figure 8C:
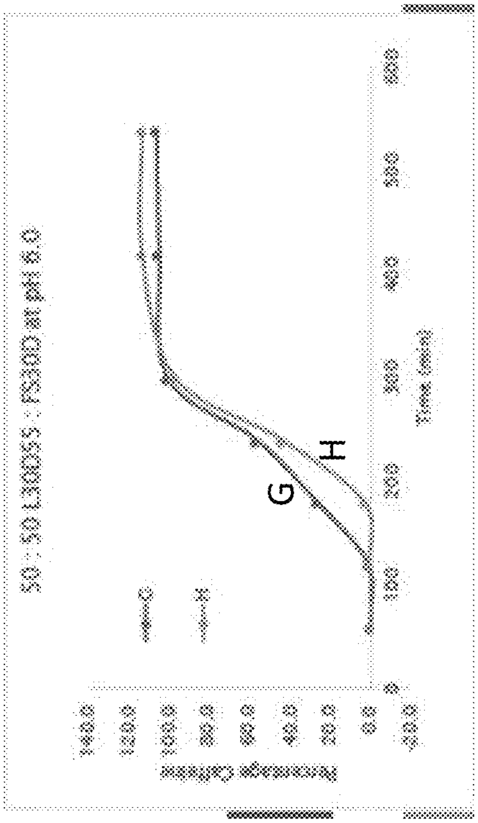

Percent of caffeine released at pH 7.0 was measured for each of capsule formulations A-B (FIG. 6A), capsule formulations C-F (FIG. 6B), and capsule formulations G-H (FIG. 6C). Percent of caffeine released at pH 6.5 was measured for each of capsule formulations A-B (FIG. 7A), capsule formulations C-F (FIG. 7B), and capsule formulations G-H (FIG. 7C). Percent of caffeine released at pH 6.0 was measured for each of capsule formulations A-B (FIG. 8A), capsule formulations C-F (FIG. 8B), and capsule formulations G-H (FIG. 8C).

Figure 9B:
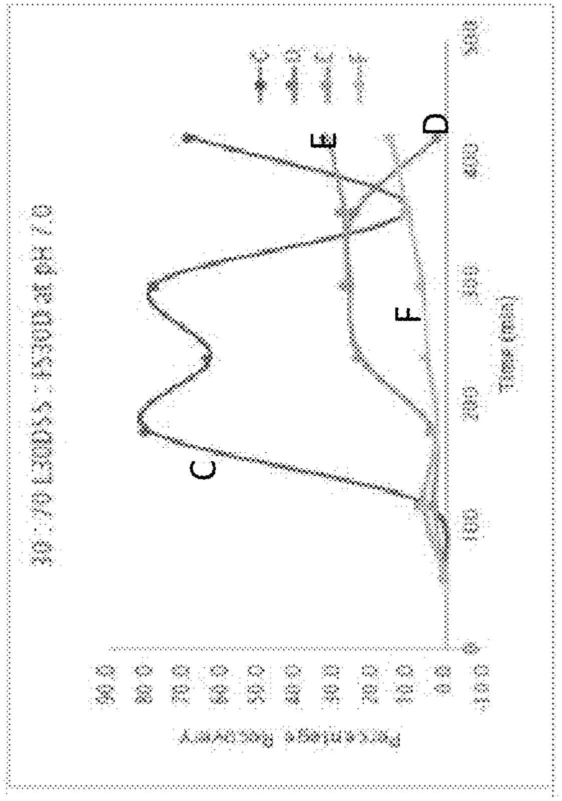
FIGS. 9A-9C illustrate percent target construct (SEQ ID NO: 5) release from various capsule coatings, the first hour at pH 1.0 and the remaining time at pH 7.0.
Figure 9A:
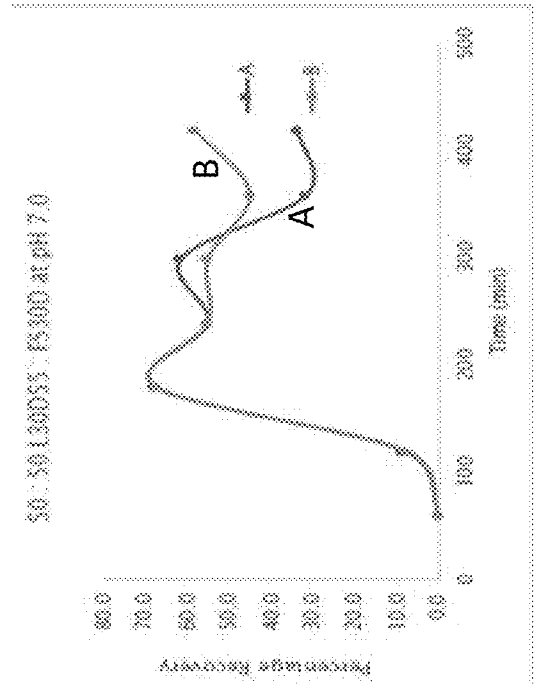
Figure 9C:
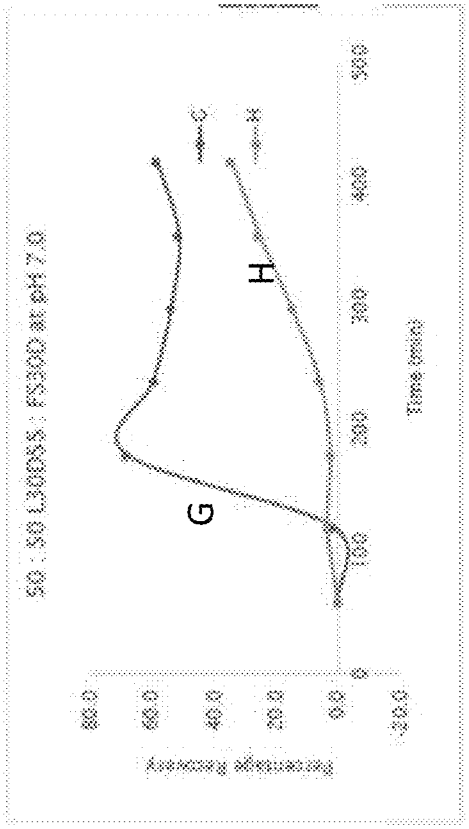
Figure 10B:
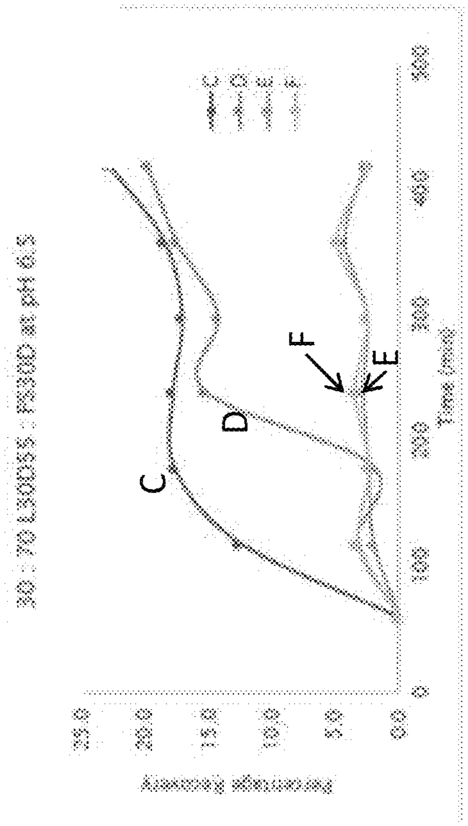
FIGS. 10A-10C illustrate percent target construct (SEQ ID NO: 5) release from various capsule coatings, the first hour at pH 1.0 and the remaining time at pH 6.5.
Figure 10A:
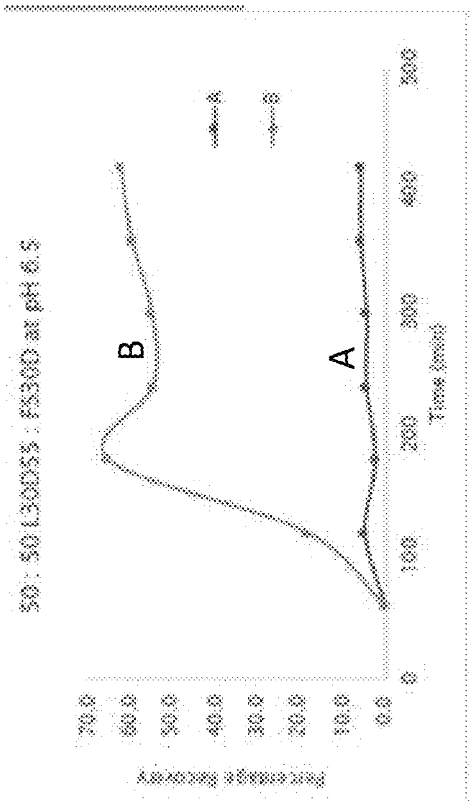
Figure 10C:
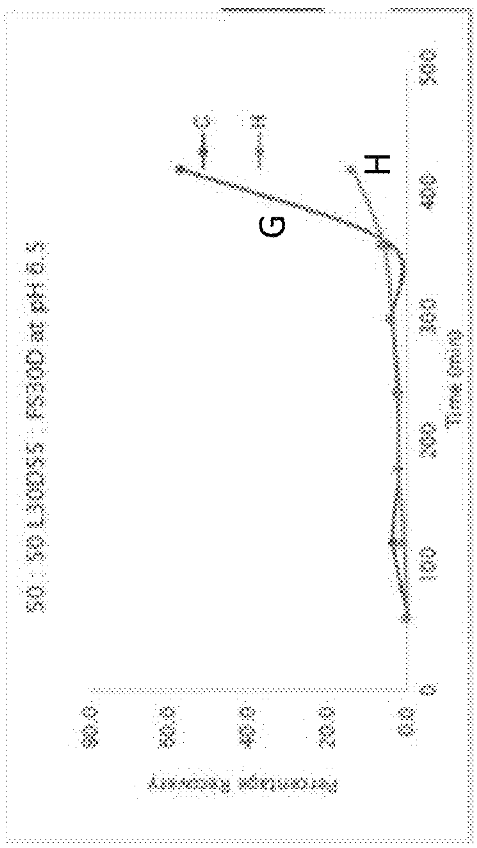
Figure 11A:
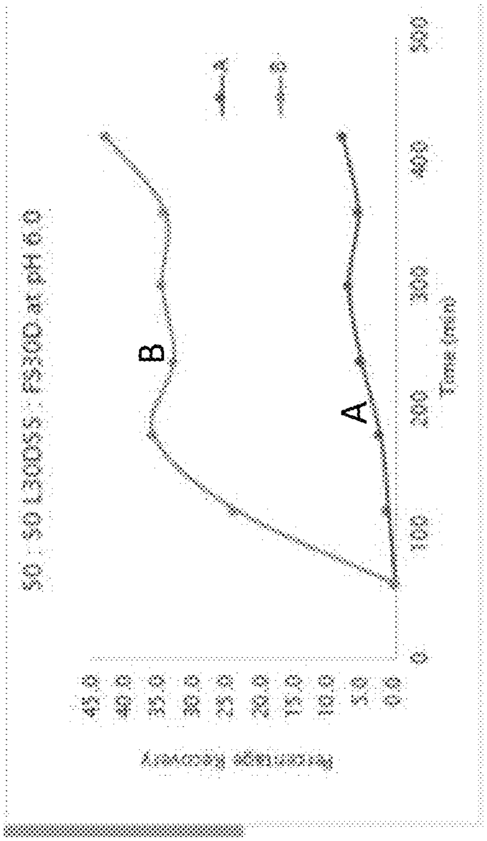
FIGS. 11A-11C illustrate percent target construct (SEQ ID NO: 5) release from various capsule coatings, the first hour at pH 1.0 and the remaining time at pH 6.0.
Figure 11B:
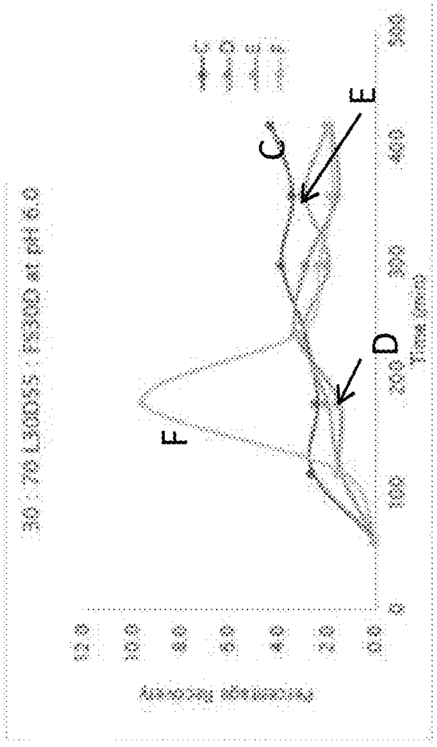
Figure 11C:
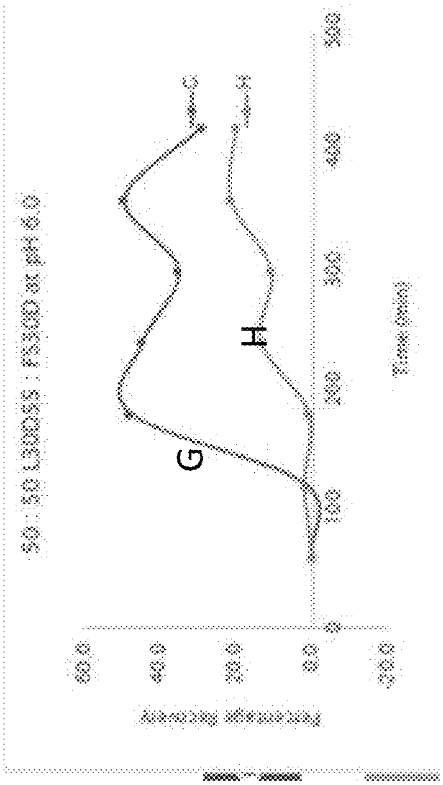

Percent of target construct released at pH 7.0 was measured for each of capsule formulations A-B (FIG. 9A), capsule formulations C-F (FIG. 9B), and capsule formulations G-H (FIG. 9C). Percent of target constructs released at pH 6.5 was measured for each of capsule formulations A-B (FIG. 10A), capsule formulations C-F (FIG. 10B), and capsule formulations G-H (FIG. 10C). Percent of target constructs released at pH 6.0 was measured for each of capsule formulations A-B (FIG. 11A), capsule formulations C-F (FIG. 11B), and capsule formulations G-H (FIG. 11C).

Figure 12B:
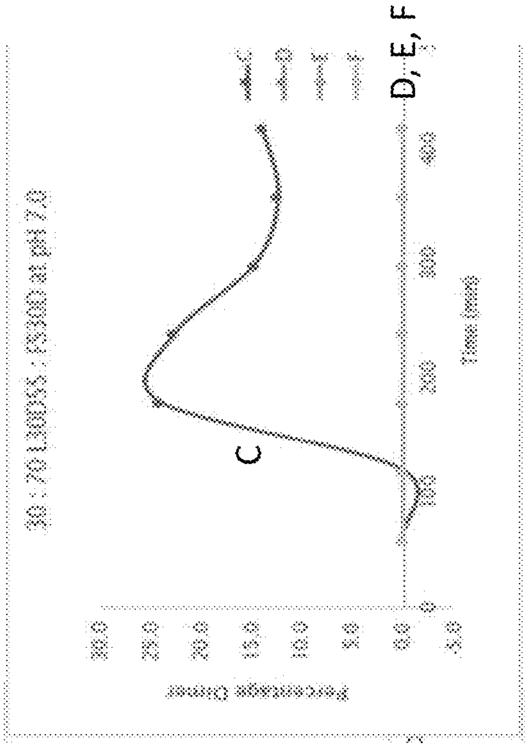
FIGS. 12A-12C illustrate percent released target constructs (SEQ ID NO: 5) in the dimer form from various capsule coatings, the first hour at pH 1.0 and the remaining time at pH 7.0.
Figure 12A:
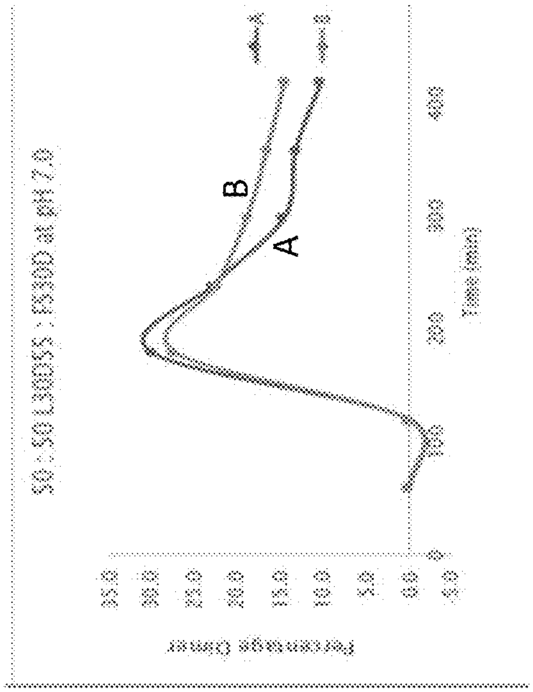
Figure 12C:
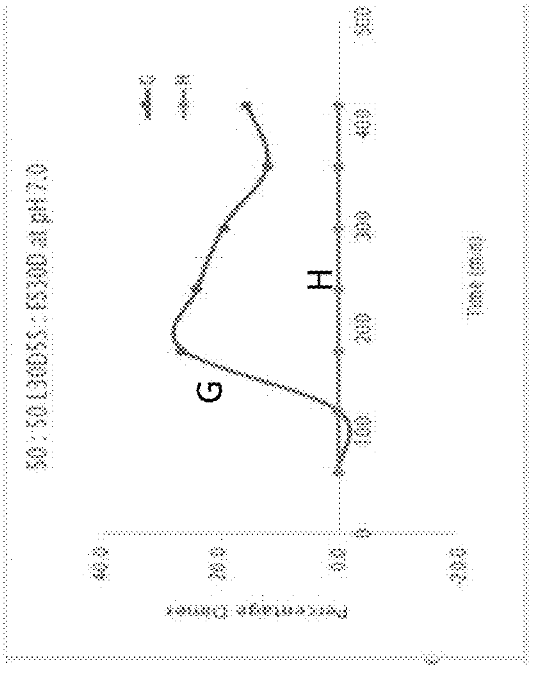
Figure 13A:
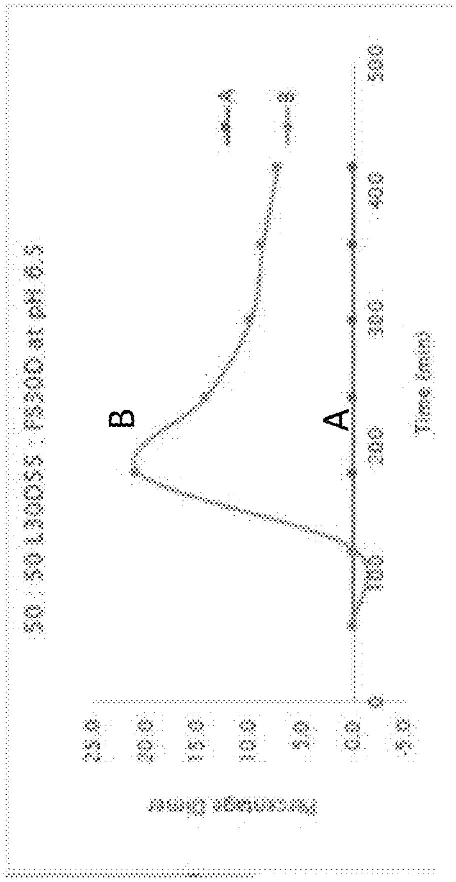
FIGS. 13A-13C illustrate percent released target constructs (SEQ ID NO: 5) in the dimer form from various capsule coatings, the first hour at pH 1.0 and the remaining time at pH 6.5.
Figure 13B:
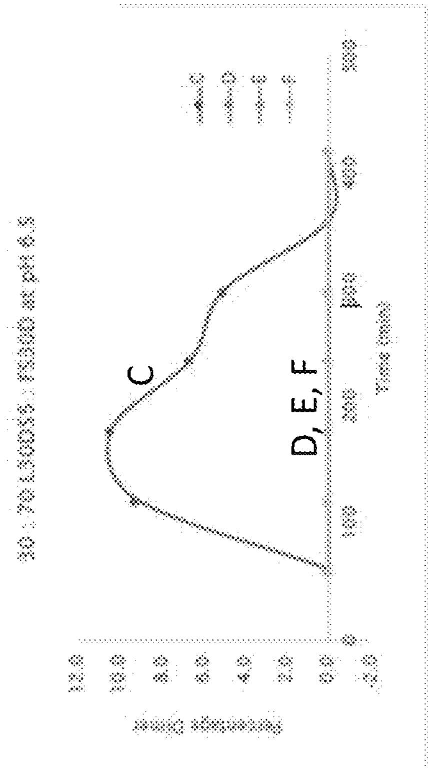
Figure 13C:
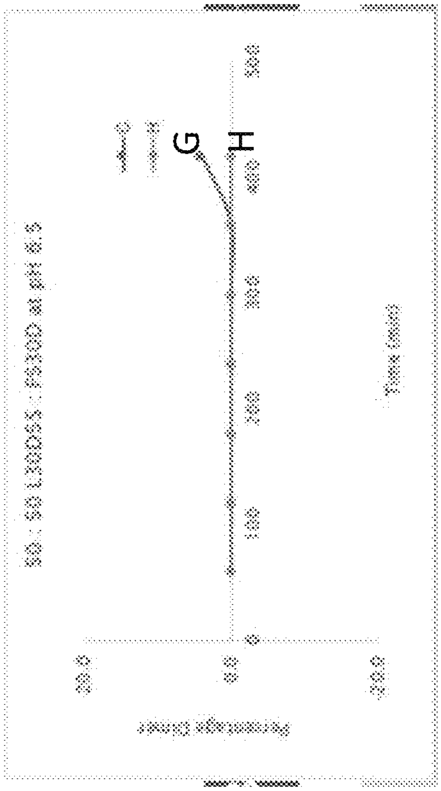
Figure 14B:
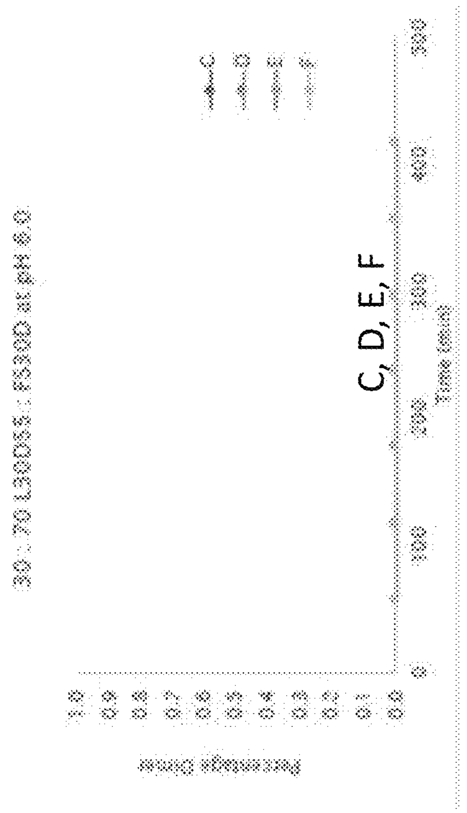
FIGS. 14A-14C illustrate percent released target constructs (SEQ ID NO: 5) in the dimer form from various capsule coatings, the first hour at pH 1.0 and the remaining time at pH 6.0.
Figure 14A:
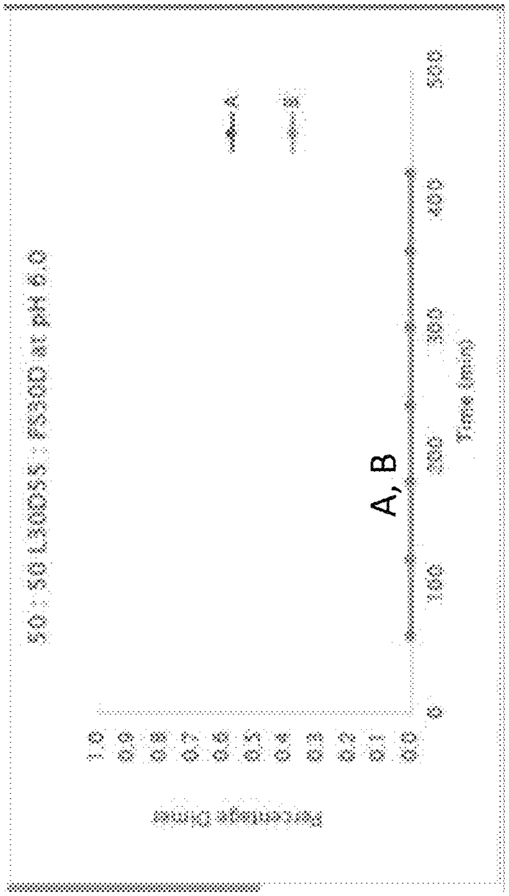
Figure 14C:
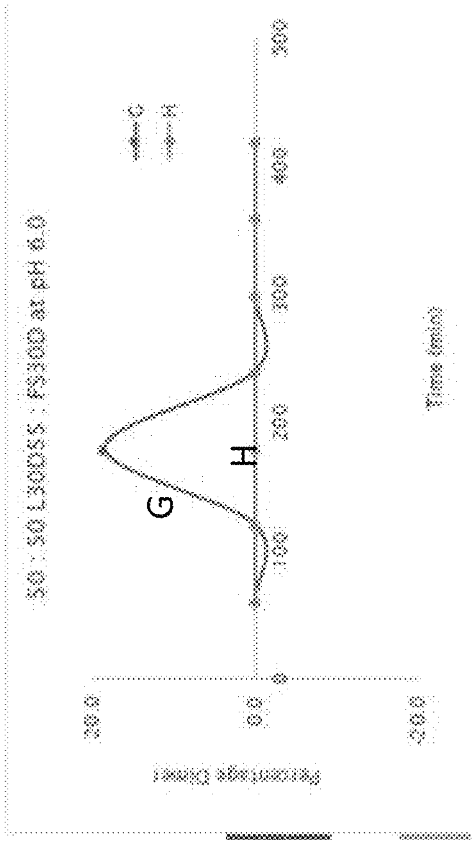

The percent of the released target constructs in the dimer form was also determined. Percent of released target construct in the dimer form at pH 7.0 was measured for each of capsule formulations A-B (FIG. 12A), capsule formulations C-F (FIG. 12B), and capsule formulations G-H (FIG. 12C). Percent of released target constructs in the dimer form at pH 6.5 was measured for each of capsule formulations A-B (FIG. 13A), capsule formulations C-F (FIG. 13B), and capsule formulations G-H (FIG. 13C). Percent of released target constructs in the dimer form at pH 6.0 was measured for each of capsule formulations A-B (FIG. 14A), capsule formulations C-F (FIG. 14B), and capsule formulations G-H (FIG. 14C).

Example 9: Capsule Coating Study in Cynomolgus Monkeys

Figure 15B:
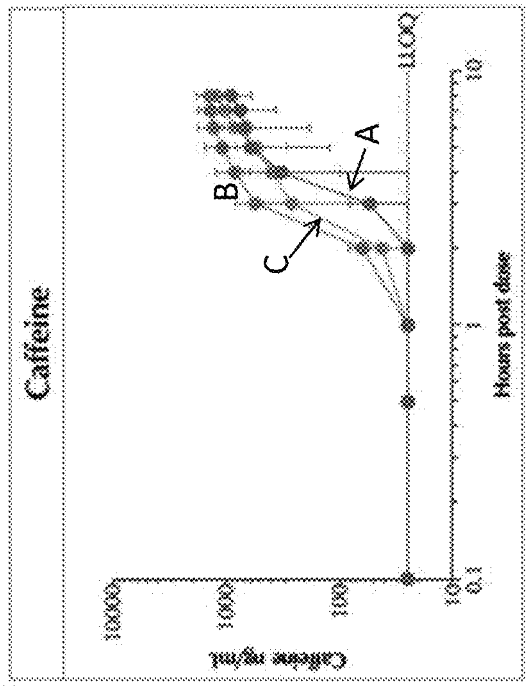
FIGS. 15A-15C illustrate serum levels in cynomolgus monkeys of IL-10, caffeine, and interleukin-1 receptor antagonist (IL-IRA) during the 8 hours following administration to the monkeys of capsules containing a target construct (SEQ ID NO: 5) and caffeine with one of capsule coatings A, B, or C as shown in TABLE 25.
Figure 15A:
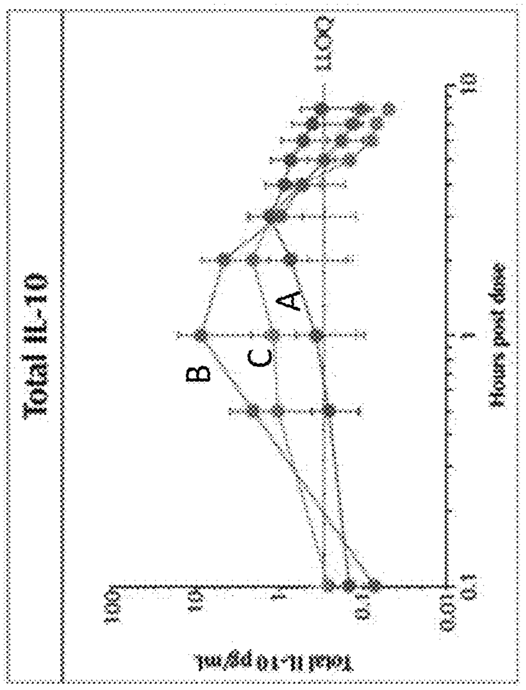
Figure 15C:
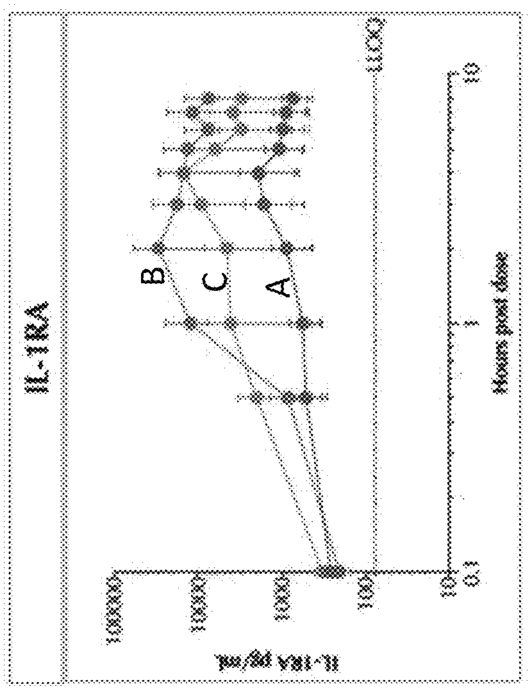
Figure 16A:
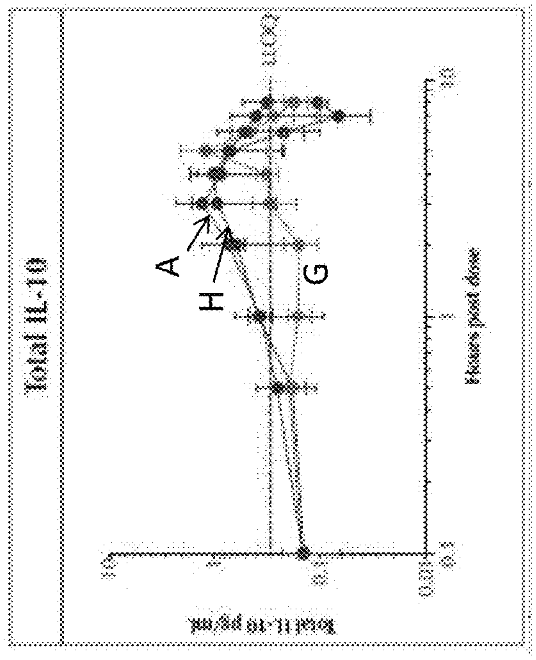
FIGS. 16A-16C illustrate serum levels in cynomolgus monkeys of IL-10, caffeine, and IL-IRA during the 8 hours following administration to the monkeys of capsules containing a target construct (SEQ ID NO: 5) and caffeine with one of capsule coatings A, G, and H as shown in TABLE 25.
Figure 16B:
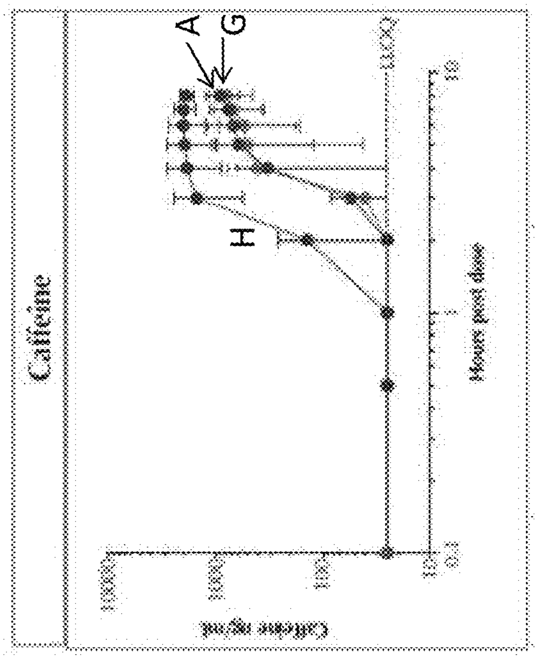
Figure 16C:
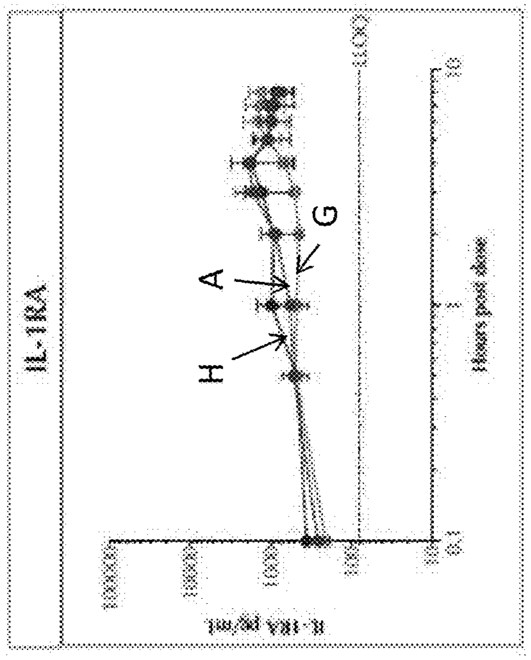
Figure 17B:
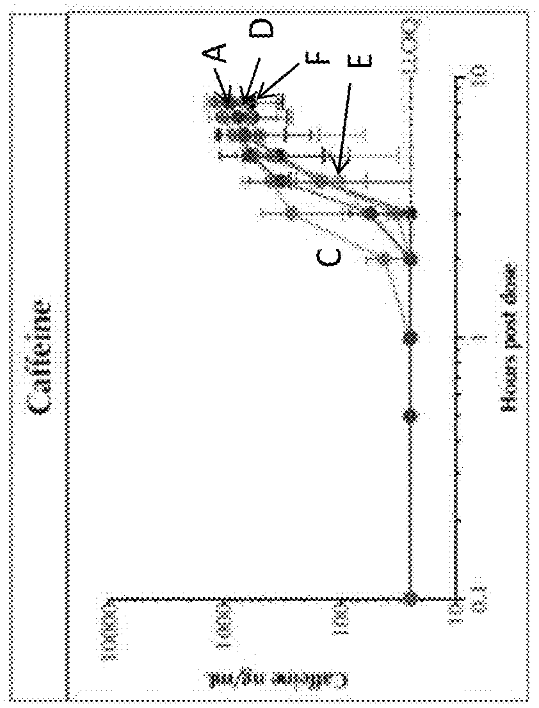
FIGS. 17A-17C illustrate serum levels in cynomolgus monkeys of IL-10, caffeine, and IL-IRA during the 8 hours following administration to the monkeys of capsules containing a target construct (SEQ ID NO: 5) and caffeine with one of capsule coatings A, C, D, E, and F as shown in TABLE 25.
Figure 17A:
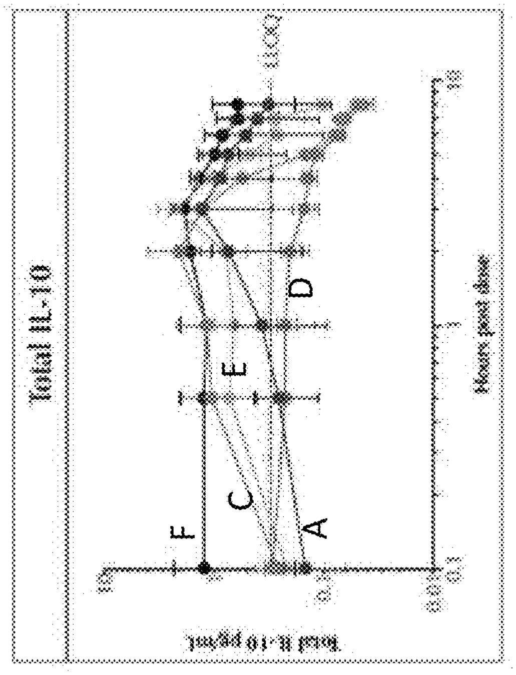
Figure 17C:
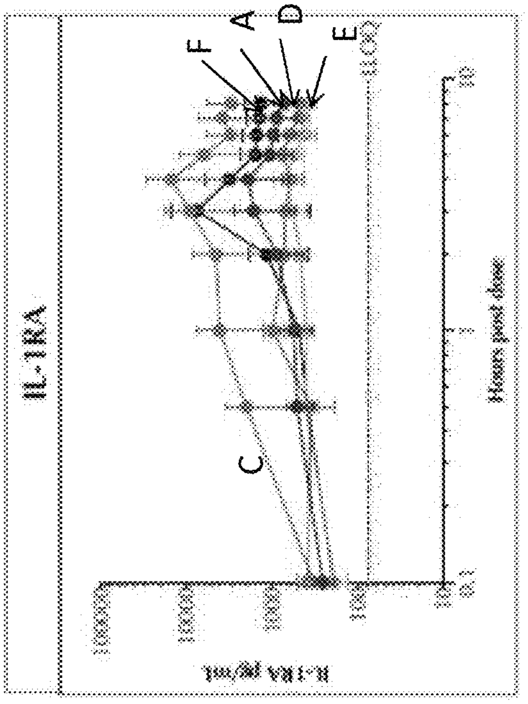

Eight capsule coating formulations (Formulations A-H in TABLE 25) were tested in male cynomolgus monkeys. Capsules were administered as a single dose, with 2 capsules per animal, and were orally administered with a pill gun. Plasma samples were collected 8 hours post capsule administration and analyzed for IL-10 (FIGS. 15A, 16A, and 17A), caffeine (FIGS. 15B, 16B, and 17B), and interleukin-1 receptor antagonist (IL-IRA) (FIGS. 15C, 16C, and 17C).

TABLE 25

Formulation of capsules administered to cynomolgus monkeys

| Formulation Identifier | Target construct amount (mg) per capsule | Caffeine amount (mg) per capsule | HPMC Capsule Coat (mg) | Eudragit ® Composition (L30D55/FS30D) | Eudragit ® Coat Weight gain | Description | Number of capsules per animal | N |
|---|---|---|---|---|---|---|---|---|
| A | 10 | 10 | 10 | 50/50 | 62 | Reference composition | 2 | 3 |
| B | 10 | 10 | 10 | 50/50 | 31 | Thin Eudragit ® 50/50 | 2 | 3 |
| C | 10 | 10 | 10 | 30/70 | 31 | Thin Eudragit ® 30/70 | 2 | 3 |
| D | 10 | 10 | 10 | 30/70 | 62 | Standard 30/70 | 2 | 3 |
| E | 10 | 10 | 10 | 30/70 | 92 | Standard 30/70 | 2 | 3 |
| F | 10 | 10 | 10 | 30/70 | 123 | Thick 30/70 | 2 | 3 |
| G | 10 | 10 | 60 | 50/50 | 31 | Increase HPMC | 2 | 3 |
| H | 10 | 10 | 180 | 50/50 | 31 | Thick HPMC | 2 | 3 |

A robust caffeine signal indicated capsule opening behavior. Capsule opening time and kinetics (from caffeine) correlated well with in vitro dissolution data. Thinner coats showed the most rapid opening (30 mg coat of 50/50 Eudragit® L30D55/FS30D and 30/70 Eudragit® L30D55/FS30D). Systemic Il-10 and IL-IRA levels were elevated for some formulations. Time course of PK and biomarker signals correlated well with caffeine release time course data. Thinner coats showed the most significant elevation of systemic IL-10 and IL-1RA (30 mg coat of 50/50 Eudragit® L30D55/FS30D and 30/70 Eudragit L30D55/FS30D).

Example 10: Development of Powder with Improved Characteristics

Lyophilized composition compositions of low density can have poor flow characteristics. The goal was to develop a lyophilized composition formulation with increased density and improved flow properties. The lyophilized composition was blended with excipients to improve capsule filling or enable tablet formulation.

Recombinant human serum albumin (rHSA) was used as a surrogate protein for filing. Lyophilized rHSA (lyo-rHSA) was made with the same process, composition, and density as lyophilized target constructs, with a target of 20 mg API per capsule (equivalent to 56 mg lyophilized composition).

The Profill capsule filling system was used to generate seven different blends (TABLE 26), including a lyophilized drug substance (containing only lyophilized rHSA) as well as the lyophilized drug substance in addition with other excipients, such as glycine and sucrose.

TABLE 26

Profill blends

| Mixture | Target Fill Weight (mg) | Target Filled Capsule Weight (mg) | % Acceptable Capsules ± 5% | % Acceptable Capsules ± 7.5% |
|---|---|---|---|---|
| 100% lyo-rHSA | 56.4 | 118.0 | 53 | 82 |
| 95% lyo-rHSA, 5% Glycine | 59.4 | 121.0 | 65 | 78 |
| 90% lyo-rHSA, 10% Glycine | 62.6 | 124.4 | 45 | 63 |
| 80% lyo-rHSA, 20% Glycine | 70.4 | 132.0 | 29 | 42 |
| 95% lyo-rHSA, 5% 2:1 Sucrose:Glycine | 59.4 | 121.0 | 61 | 75 |
| 90% lyo-rHSA, 10% 2:1 Sucrose:Glycine | 62.8 | 124.4 | 57 | 66 |
| 80% lyo-rHSA, 10% 2:1 Sucrose:Glycine | 70.4 | 132.0 | 55 | 69 |

In conclusion, ProFill was feasible system to use to fill capsules with a powder, such as the lyophilized IL-10 delivery construct. It could also be concluded that the addition of excipients was not necessary to achieve powder fill by ProFill. Additionally, powder from capsules which do not meet the weight targets can be recovered and recycled.

Example 11: Compatibility Screening of Target Construct and Compacting Excipients The compatibility of various tablet excipients with the IL-10 delivery construct (SEQ ID NO: 5) was evaluated in the dry (powder) state.

Figure 18:
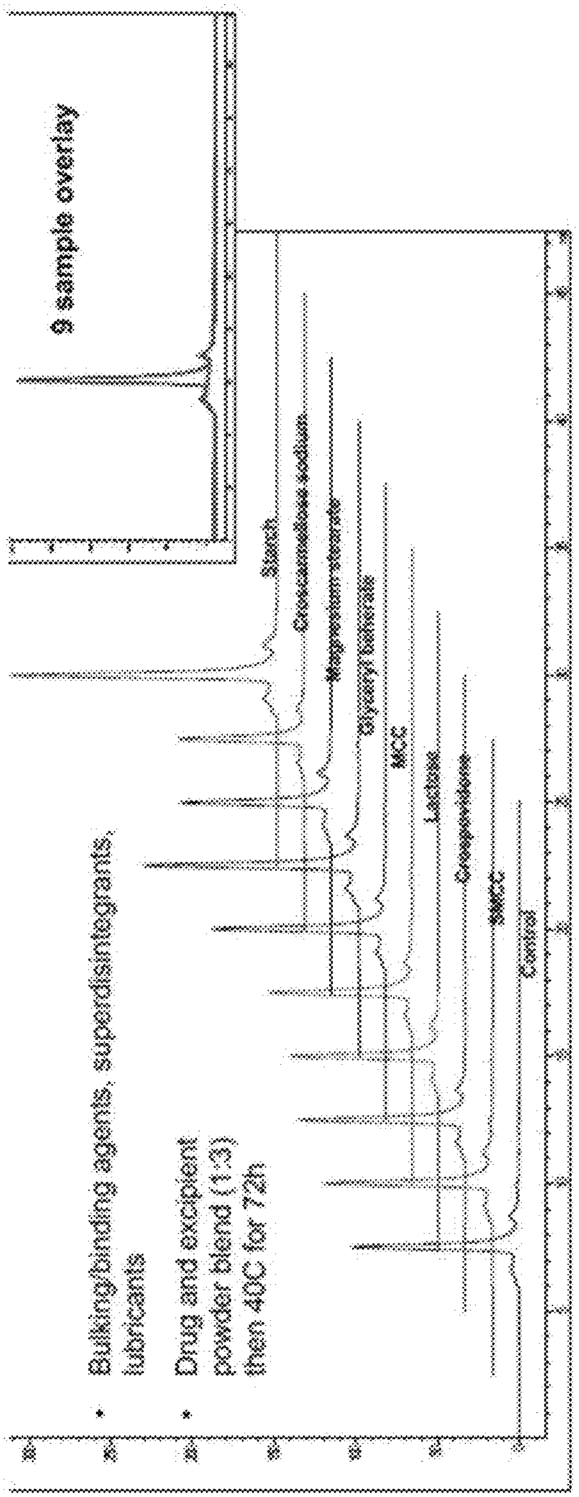
FIG. 18 illustrates a size exclusion chromatogram (SEC) of combinations of different compacting excipients and a lyophilized target construct (SEQ ID NO: 5) powder after being incubated at 40° C. for 3 days. Compacting excipients examined included: starch, croscarmellose sodium, magnesium stearate, glyceryl behenate, microcrystalline cellulose (MCC), lactose, crospovidone, and silicified microcrystalline cellulose (SMCC).

The IL-10 delivery construct in the dry state (IL-10 delivery construct drug substance, or DS, developed using the formulation buffer previously determined to have the best overall stability (10 mM potassium phosphate, 2% glycine, 1% sucrose, 0.3% poloxamer 188 at a pH of 7.5), as described in Example 5) was blended with each individual excipient then incubated standing at 40° C. for 72 h before analysis. The composition and analytical summary of each sample is described in TABLE 27. IL-10 delivery construct DS and excipient (equal weight of each, 1:3 ratio of API:excipient) were placed in a capped 4 mL borosilicate glass vial and blended using TURBULA® system for 2 minutes, then samples were incubated standing at 40° C. for 72 h in a capped 4 mL borosilicate glass vial. The powder blend was then reconstituted with PBS to 0.5 mg/mL solution of the IL-10 delivery construct. Samples were then passed through 0.2 μm filter prior to SEC analysis (FIG. 18). No incompatibility with target constructs was observed in the powder state.

TABLE 27

Composition and SEC analysis of dry-blended IL-10 delivery construct/excipient powders

| Composition | | | | | SEC Analysis | | |
|---|---|---|---|---|---|---|---|
| Sample # | Excipient | Grade | Weight (mg) | API weight (mg) | HMW | Dimer | Monomer |
| 1 | DS only | NA | 0 | 12 | 10.1 | 81.5 | 7.1 |
| 2 | Silicified microcrystalline cellulose | Prosolv SMCC 90 | 36 | 12 | 11.7 | 82.4 | 5.9 |
| 3 | Crospovidone | Kollidon CL | 36 | 12 | 11.7 | 80.3 | 8 |
| 4 | Lactose monohydrate | Ligamed | 36 | 12 | 12.2 | 81.2 | 6.7 |
| 5 | MCC | VIVAPUR | 36 | 12 | 12.7 | 81.0 | 6.2 |
| 6 | Glyceryl behenate | COMPRITOL | 36 | 12 | 12.3 | 80.1 | 7.6 |
| 7 | Magnesium stearate | Ligamed | 36 | 12 | 11.5 | 79.2 | 9.3 |
| 8 | Croscarmellose soldium | VIVASOL GF | 36 | 12 | 12.9 | 79.2 | 7.8 |
| 9 | Starch | Aldrich | 36 | 12 | 12.5 | 80.8 | 6.7 |

-

For tablet manufacturing, material was subjected to compaction and compression processes. For a protein drug with potentially sensitive tertiary and quaternary structure, these mechanical stresses require investigation for the retention of protein integrity.

The compatibility of the IL-10 delivery construct was evaluated for the initial steps of tablet formation. Blending and compaction processes were conducted. Both roller compaction and slugging was conducted, with subsequent milling to granules in each case. The composition of each formulation is shown in TABLE 28. In order to explore excipient functionality and compatibility, different excipients were included in the three formulations.

TABLE 28

Compositions of initial formulations for compaction/granulation; IG = intragranular composition; EG = extragranular composition. % values are w/w and are nominal values (not corrected for protein content)

| | F1 Formulation | | | F2 Formulation | | | Slugging/granulation Formulation | | |
|---|---|---|---|---|---|---|---|---|---|
| Component | Identity | IG (%) | EG (%) | Identity | IG (%) | EG (%) | Identity | IG (%) | EG (%) |
| Active ingredient | SEQ ID NO: 5 | 8.00 | — | SEQ ID NO: 5 | 8.00 | — | SEQ ID NO: 5 | 17.31 | — |
| Bulking agent | SMCC | 68.00 | 18.35 | DCP/MCC | 68.00 | 18.35 | Sucrose | 72.32 | — |
| Disintegrant | Crospovidone | 3.00 | 1.00 | Croscarmellose sodium | 3.00 | 1.00 | Crospovidone | 3.24 | 1.94 |
| Lubricant | Mg stearate | 1.00 | 0.25 | Mg stearate | 1.00 | 0.25 | Glyceryl behenate | 3.24 | 1.94 |

The results from 2 pre-blend formulations (F1 and F2) are shown in TABLE 29. Roller compaction was conducted at 2 forces, and the resulting ribbons were individually granulated. Materials were reconstituted in PBS at 0.65 mg/mL SEQ ID NO: 5 and filtered with 0.2 um filter (Advantec) before SEC analysis. Samples were also incubated at 40° C. for two weeks before reconstitution and analysis.

TABLE 29

IL-10 delivery construct (SEQ ID NO: 5) dimer purity during granulation process for formulations F1 and F2; Roller compaction at 2 forces on small-scale apparatus. Granulation through 1.2 μm screen.

| | Room temperature (RT) Dimer Purity | | 40° C. Dimer Purity | |
|---|---|---|---|---|
| Intermediate | F1 | F2 | F1 | F2 |
| Drug substance (DS) | 75.9 | | 78.6 | |
| Pre-blend | 75.1 | 73.7 | 77.3 | 76.3 |
| Ribbon (low force) | 72.5 | 74.4 | 76.1 | 74.5 |
| Ribbon (high force) | 71.6 | 71.1 | 73.7 | 72.6 |
| Granule (low force) | 74.3 | 74.6 | 74.5 | 72.6 |
| Granule (high force) | 74.5 | 73.8 | 71.9 | 72.4 |

The dimer purity data of F1 and F2 intermediates indicated little difference as a result of these processing steps, and the values after 40° C. incubation were similar to the initial samples. Nonetheless each process intermediate showed somewhat reduced dimer purity compared to the drug substance.

The same analysis was conducted for the intermediates generated in the slugging/granulation process (TABLE 30). As well as the different compaction method, the slugging/granulation batch differed in binder and lubricant composition. Sample dimer purity showed little to no difference among in-process samples, and only a slight decline in dimer purity compared to the drug substance. This suggested that the composition and process of the slugging/granulation samples maintained IL-10 delivery construct integrity.

TABLE 30

IL-10 delivery construct (SEQ ID NO: 5) dimer purity during granulation process for slugging/granulation formulations

| Intermediate | Drug Substance (DS) | Sieved DS | Premix Blend | Final Blend | Slug | Granule |
|---|---|---|---|---|---|---|
| Purity | 81.2 | 79.5 | 79.4 | 80.4 | 79.3 | 78.9 |

Figure 95:
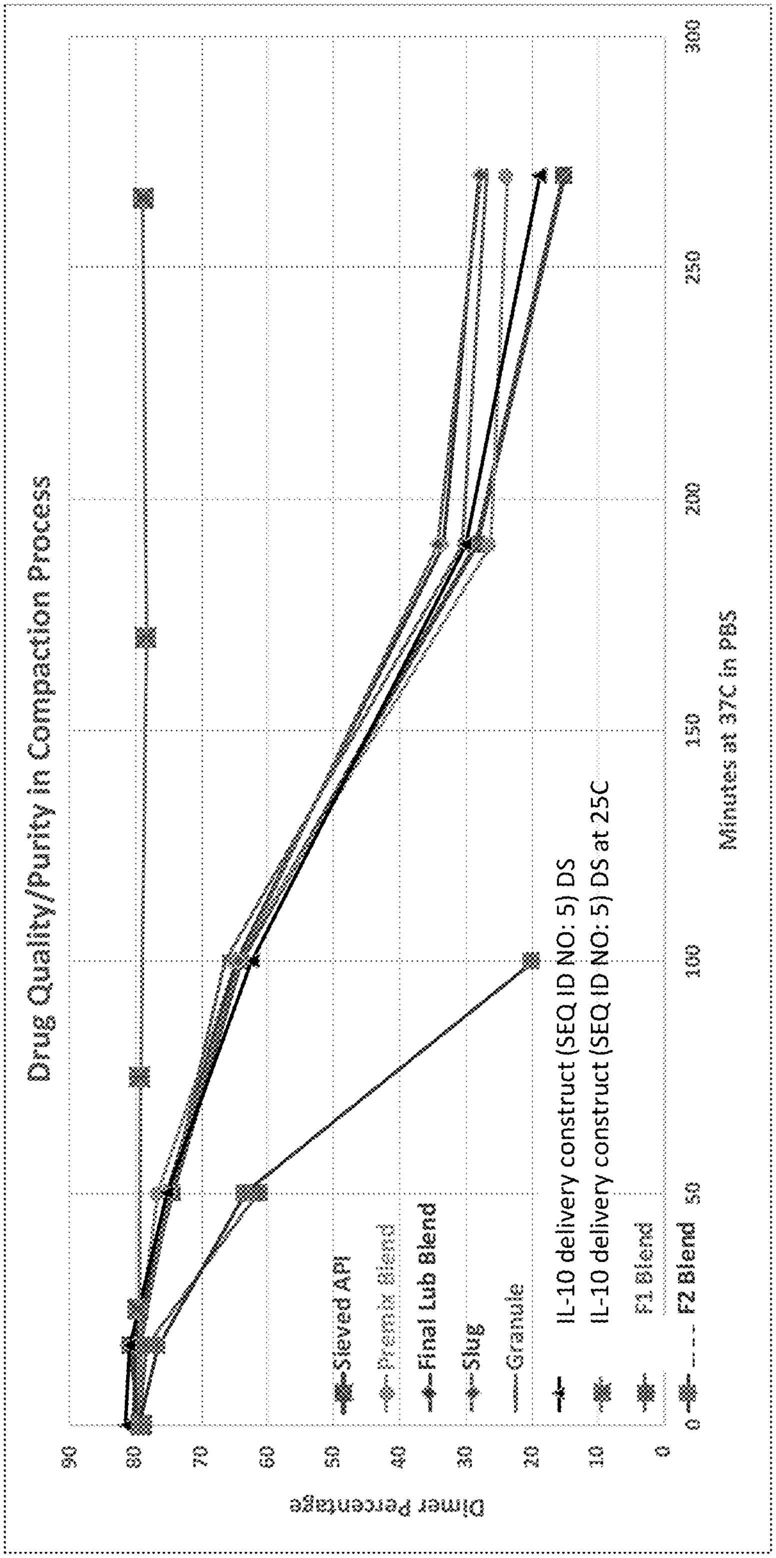
FIG. 95 illustrates the stability of the IL-10 delivery construct in PBS when compacted with various different components. Samples were reconstituted in PBS at 0.3 mg/mL IL-10 delivery construct (SEQ ID NO: 5) in Eppendorf vials, mounted on a rotisserie shaker at 37° C. for 5 h. Samples were withdrawn periodically for analysis by SEC.

Selected process intermediate samples were subjected to stability assessment following reconstitution in PBS (FIG. 95). IL-10 delivery construct (SEQ ID NO: 5) solution was stable at RT over the course of the experiment, but showed significant degradation when stored at 37° C. Most samples showed comparable solution stability to IL-10 delivery construct (SEQ ID NO: 5) DS, but both the F1 and F2 blends showed faster degradation comparing to samples from the slugging/granulation process.

These results suggested that components of the F1 and F2 formulations were less compatible with SEQ ID NO: 5, or that the compacting process may be affecting IL-10 delivery construct (SEQ ID NO: 5).

Figure 96:
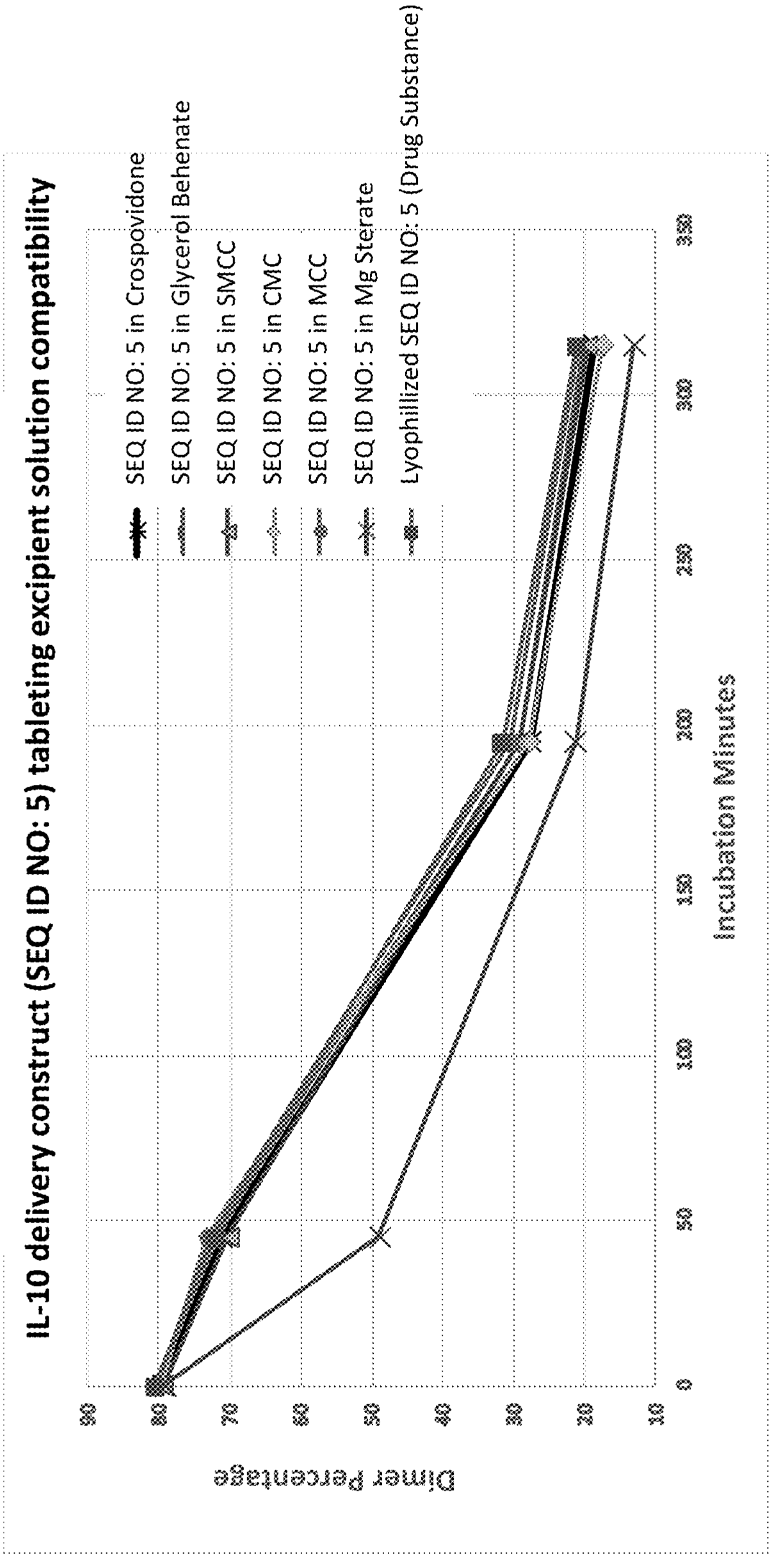
FIG. 96 illustrates IL-10 delivery construct/excipient compatibility in solution.

To identify if detrimental components were present in the F1/F2 composition, individual excipients were evaluated for compatibility with IL-10 delivery construct (SEQ ID NO: 5) in solution. DS and a single excipient were suspended in PBS at 0.3 mg/mL IL-10 delivery construct (SEQ ID NO: 5). Samples were incubated at 37° C. with shaking for 5 h, with samples being periodically withdrawn for SEC analysis. The results are shown in FIG. 96.

Most samples showed comparable degradation to IL-10 delivery construct (SEQ ID NO: 5) DS, but the presence of magnesium stearate, used as lubricant in F1/F2 compositions, caused a significant increase in IL-10 delivery construct (SEQ ID NO: 5) degradation rate. Notably, glyceryl dibehenate did not show adverse effect on IL-10 delivery construct (SEQ ID NO: 5) dimer purity.

Figure 97:
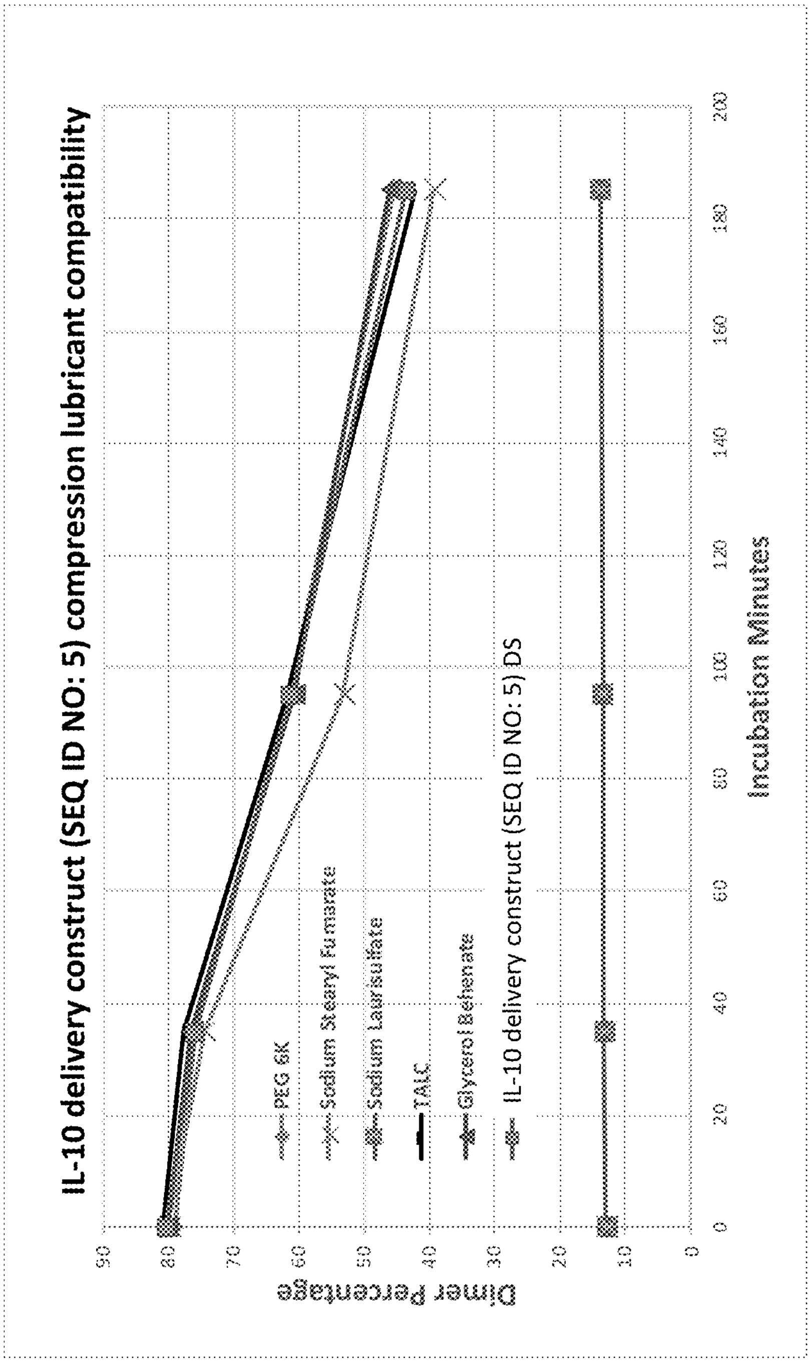
FIG. 97 illustrates the compatibility of various lubricant excipients with an IL-10 delivery construct.

Magnesium stearate has ionic surfactant-like properties, whereas glyceryl behenate is a non-ionic surfactant. To further characterize lubricant compatibility a series of additional lubricant candidates were evaluated. The results are shown in FIG. 97.

Sodium stearyl fumarate, a fatty acid salt related to magnesium stearate, caused slightly accelerated degradation of IL-10 delivery construct (SEQ ID NO: 5). Sodium laurisulfate, with the strongly anionic sulfate group, degraded IL-10 delivery construct (SEQ ID NO: 5) immediately upon mixing.

Example 12: Screening of Compression Forces for Tablet Development

Figure 19:
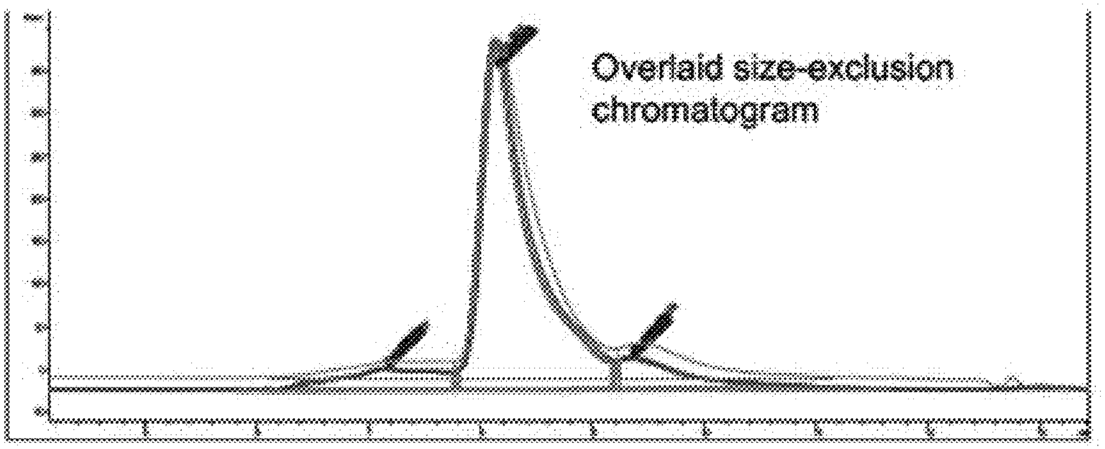
FIG. 19 illustrates a size exclusion chromatogram (SEC) showing target construct (SEQ ID NO: 5) dimer purity as well as dimer purity of the target construct (SEQ ID NO: 5) of the F1 and F2 formulations.
Figure 20A:
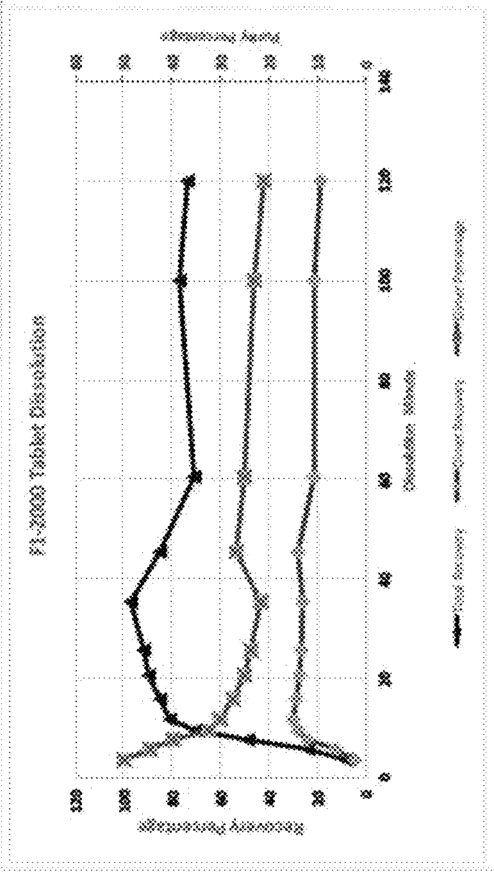
FIGS. 20A-20D illustrate total recovery of the target construct (SEQ ID NO: 5), recovery of the dimer, and dimer percentage following dissolution of different tablet formulations.
Figure 20B:
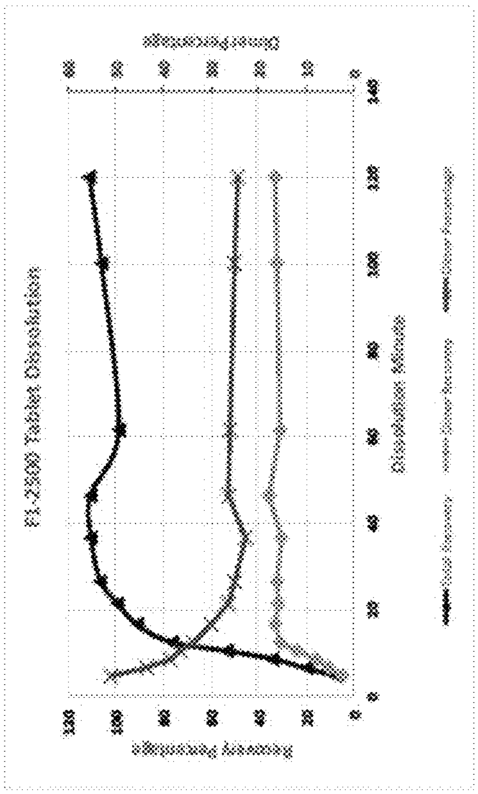
Figure 20C:
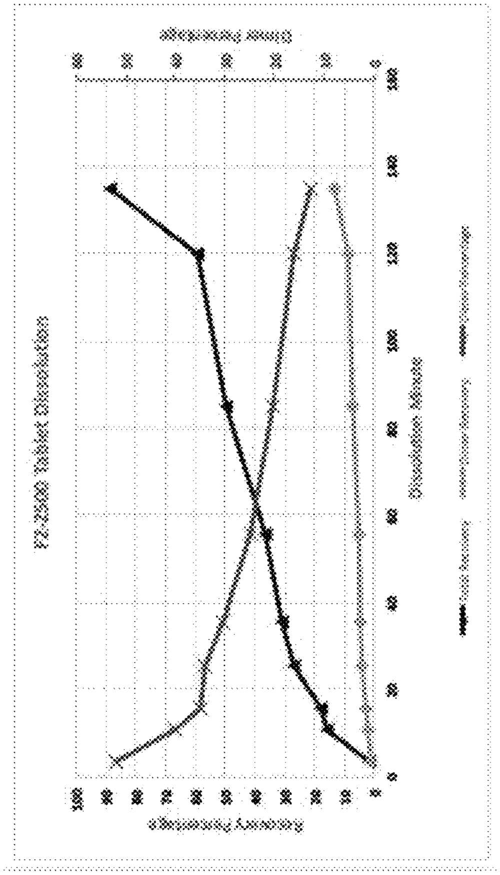
Figure 20D:
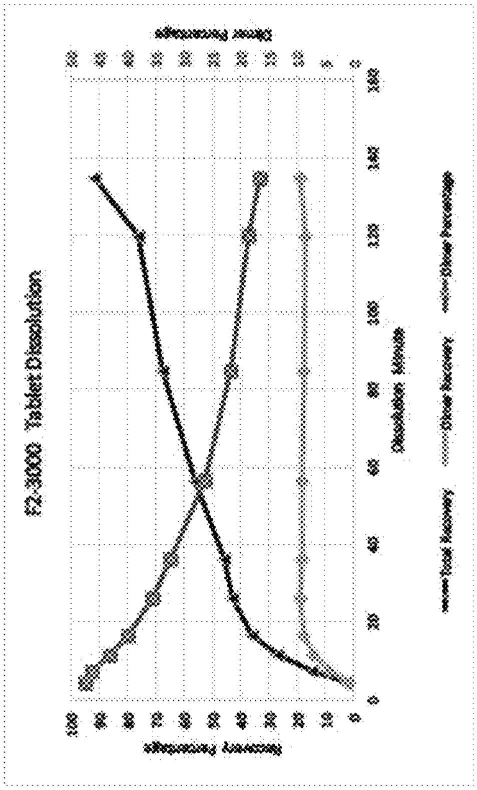

Various compression forces were used to create F1 tablets (TABLE 31) and F2 tablets (TABLE 32). Dimer purity of the target construct was also examined following compaction into a tablet. The target construct protein was robust to compaction and granulation, although some aggregation was observed in final tablet form (FIG. 19). Dimer recovery was also assessed following dissolution of various tablets at pH 7.0 (FIGS. 20A-20D).

TABLE 31

F1 tablet properties

| Product | Compression Force, lb · f | Thickness, mm | Friability Screen (n = 1), % (±0.5%) | Hardness, kp | Disintegration (fragment), 37° C. |
|---|---|---|---|---|---|
| IL-10 delivery construct (SEQ ID NO: 5), F-1 tablets From final blend lot #44A | 2,000 | 4.04 | 0.0 | 18.4 | 2 min 45 sec: swelling + erosion |
| | 2,500 | 3.88 | 0.0 | 25.0 | 10 min: slight swelling initially, then slow erosion |
| | 3,000 | 3.83 | 0.0 | 26.5 | 14 mins 30 sec: slow erosion |
| | 3,500 | 3.80 | 0.0 | 27.1 | 16 min: slow erosion |

TABLE 32

F2 tablet properties

| Product | Compression Force, lb · f | Thickness, mm | Friability screen (n = 1), % (±0.5%) | Hardness, kp | Disintegration (fragment), 37° C. |
|---|---|---|---|---|---|
| IL-10 delivery construct (SEQ ID NO: 5), F-2 tablets From final blend Lot #46A | 2,000<br>2,500<br>3,000<br>3,500 | 3.74<br>3.61<br>3.49<br>3.49 | 0.0<br>0.0<br>0.0<br>0.0 | 14.4<br>16.2<br>20.4<br>20.4 | 1 min 10 sec: rapid collapse to fine particles<br>10 min: slight swelling<br>3 min: erosion<br>5 min 30 sec: slow erosion<br>7 min: slow erosion |

An additional tablet (F3) was created, which was similar to an F1 tablet but with glyceryl dibehenate in place of magnesium stearate (TABLE 33). This substitution was made due to incompatibility of magnesium stearate in dissolution of target constructs in solution.

TABLE 33

F3 tablet composition F3

| Phase | Constituent | Grade | Proportion, % | Mass per tablet, mg | Quantity in g, for 15 g batch |
|---|---|---|---|---|---|
| IG | IL-10 delivery construct | n/a | 8.000% | 16 | 1.2000 |
| | SMCC | Prosolv SMCC 90 | 68.000% | 136 | 10.2000 |
| | Crospovidone | Kollidon CL | 3.000% | 6 | 0.4500 |
| | Glyceryl dibehenate | Compritol 888 ATO | 1.000% | 2 | 0.1500 |
| EG | SMCC | Prosolv SMCC 90 | 18.750% | 37.5 | 2.8125 |
| | Crospovidone | Kollidon CL | 1.000% | 2 | 0.1500 |
| | Glyceryl dibehenate | Compritol 888 ATO | 0.250% | 0.5 | 0.0375 |
| | Total core weight | | 100.000% | 200 | 15.0000 |

Example 13: Evaluation of the In Vivo Performance of Oral Capsule Coating Formulations in Healthy Subjects The primary objectives of the study are: to evaluate the in vivo performance of single oral doses of capsule coating formulations using scintigraphic methods and to compare the in vivo performance of single oral doses of a selected capsule coating formulation in the fed and fasted state using scintigraphic methods. The secondary objective of the study is: to provide information on the safety of capsule coating formulations after oral administration. The exploratory objective of the study is: to collect fasted pH, temperature and pressure profiles for each study subject as a SmartPill® transits through the gut.

Study Design

This was a single center, open-label, non-randomized, sequential, single-dose, four-period, scintigraphic imaging study in healthy subjects. A single cohort of 12 subjects was enrolled. Each subject received regimens as outlined in TABLE 34. Capsule coating formulations applied to size 0 capsules are described in TABLE 35, and release of the IL-10 delivery construct was predicted to occur in the ileum, proximal colon (later+1), or distal colon (later+2) Oral capsule coating formulations were supplied as an enteric-coated size 0 capsule intended for oral administration. This study examined capsule coating formulations and not an IL-10 delivery construct of SEQ ID NO: 5. The capsule in this study did not contain any active ingredient. There was a 3-day minimum washout period between doses. Following Period 3, there was a period of interim analysis and review of safety and scintigraphy data from previous periods in order to determine which capsule coating formulation should be selected to administer in the fed state in Period 4.

TABLE 34

Regime administered to healthy patients

| Period | Regimen | Test Product (TP) Dose |
|---|---|---|
| 1 | A | Capsule Coating Formulation 1, radiolabelled with NMT 1 MBq $^{111}$In, in the fasted state |
| 2 | B | Capsule Coating Formulation 2, radiolabelled with NMT 1 MBq $^{111}$In, in the fasted state |
| 3 | C | Capsule Coating Formulation 3, radiolabelled with NMT 1 MBq $^{111}$In, in the fasted state |
| 4 | D | Capsule Coating Formulation 1, 2 or 3, radiolabelled with NMT 1 MBq $^{111}$In, in the fed state |

$^{111}$In: indium-111;
NMT: not more than;
MBq: megabecquerel

TABLE 35

Coating formulations for scintigraphy study

| Number | Enteric coat composition (L30D55/FS30D) | Enteric coat thickness (mg) | HPMC thickness (mg) | Predicted Release |
|---|---|---|---|---|
| 1 | 50/50 | 75 | 10 | Illeum |
| 2 | 30/70 | 75 | 10 | Later +1 |
| 3 | 20/80 | 40 | 10 | Later +2 |

Subjects were screened for eligibility to participate in the study up to 28 days before dosing in Period 1. For each treatment period, eligible subjects were admitted to the clinical unit in the evening on the day before dosing (Day 1). Subjects received formulations on the morning of Day 1 following an overnight fast of a minimum of 10 h (Regimens A, B and C) or following a high-fat breakfast (Regimen D). Administration was performed on Day 1 with an appropriate interval between subjects based on scintigraphic imaging requirements (e.g., approximately 10 min). The start time was determined based on logistics. Subjects remained resident in the clinical unit until 24 h post-dose. During each fasted regimen, 4 subjects received a SmartPill® Capsule immediately following administration of the oral capsule. Each subject received the SmartPill in one regimen only; Subjects 001 to 004 received the SmartPill® in Regimen A, Subjects 005 to 008 received the SmartPill® in Regimen B and Subjects 009 to 012 received the SmartPill® in Regimen C. If data was still being captured from a SmartPill® that was in situ, the subject was not dosed in the next dosing occasion. There was a minimum washout period of 3 days between each product administration. In all periods, a 99mTc-DTPA drink was be administered with each radiolabelled test product (TP) to provide an outline of the GI tract in order to enable scintigraphic analysis. A follow-up phone call took place 5 to 7 days post-final dose to ensure the ongoing wellbeing of the subjects.

Gamma Scintigraphy

For all regimens, anterior dual isotope images of approximately 50 sec duration were collected at regular intervals up to 24 h after dosing. Images from the 99mTc-DTPA radiolabeled drink were used to provide GI tract outline only and were not be analysed. Qualitative scintigraphic data analysis was performed in order to determine the following parameters: time and anatomical location of initial radiolabel release from the capsule and time and anatomical location of complete radiolabel release from the capsule. Anatomical location of radiolabel release was defined from the following: stomach, proximal small bowel, distal small bowel, ascending colon (including the hepatic flexure), transverse colon (including the splenic flexure) and descending colon (including the sigmoid colon and rectum). Qualitative scintigraphic assessment of the transit of the capsule through the GI tract, prior to complete radiolabel release, was performed by analysing the following parameters: time of gastric emptying and time of colon arrival. Following complete radiolabel release, no further transit parameters were assessed.

pH Telemetry Capsules

During each fasted regimen, four subjects received a SmartPill® Capsule immediately after administration of the TP. Each subject received the SmartPill® in one regimen only. The SmartPill® Capsule is a single-use ingestible capsule marketed for use by physicians for diagnostic purposes. Sensors on board an ingestible capsule measure pH, temperature and pressure as the capsule travels the length of the GI tract. Measurements were transmitted from the capsule within the GI tract via an amplitude-shift keying modulated radio frequency signal at 434 MHz to a subject-worn Data Receiver and subsequently downloaded to a laptop computer for analysis and review once the capsule was passed. MotiliGI™ Software performed data analyses automatically and provided to the physician with a printable report containing gastric emptying time, and motility index. The SmartPill® Capsule was typically passed within a few days.

The shape, size and weight of the coated placebo capsule and SmartPill® were not the same, therefore the 2 capsules may not transit through the GI tract at exactly the same time. However, the SmartPill® provided data that allow pH, pressure and temperature information from different regions of the gut to be characterized.

Results

Figure 32A:
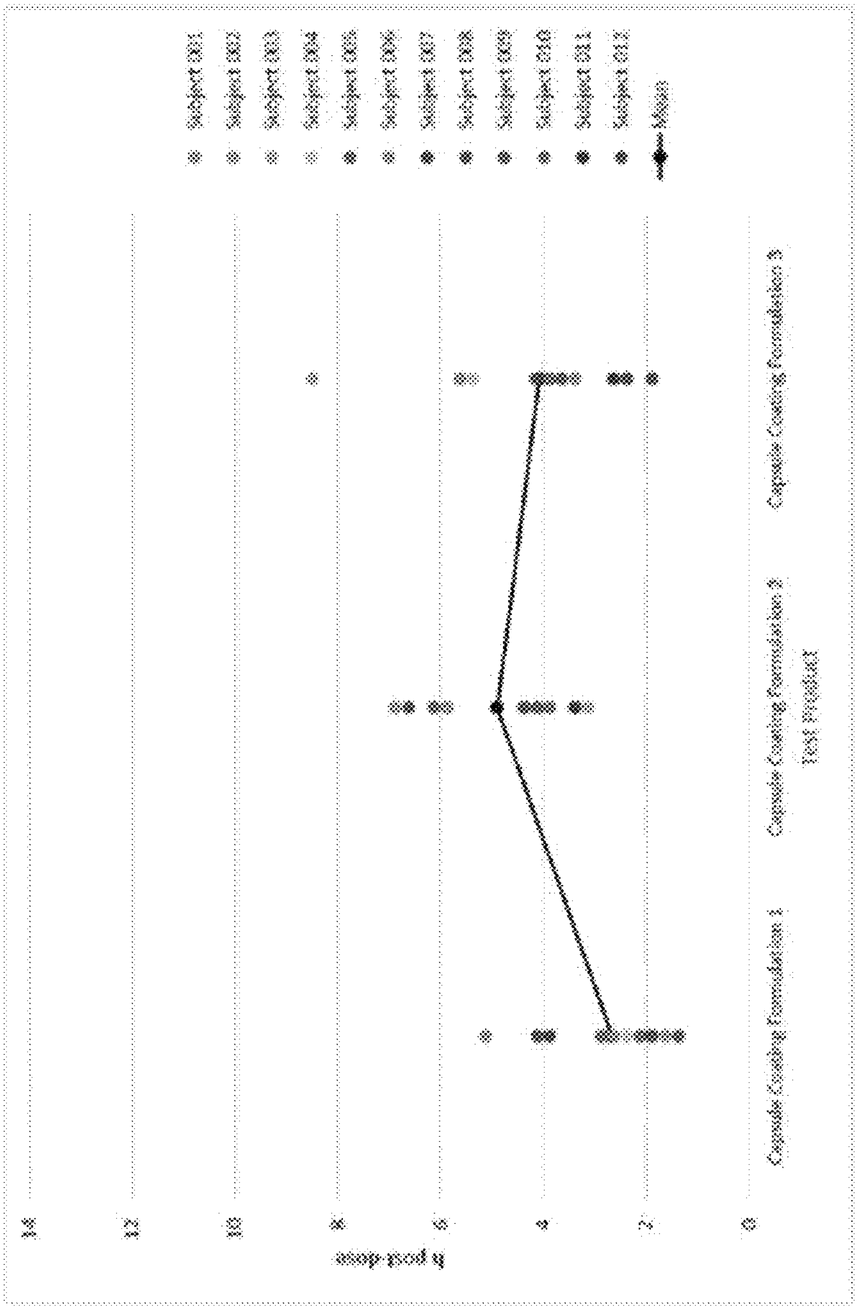
FIGS. 32A-32B illustrate time of radiolabel release from capsules with a coating of formulation 1, 2, or 3, as described in TABLE 35.
Figure 32B:
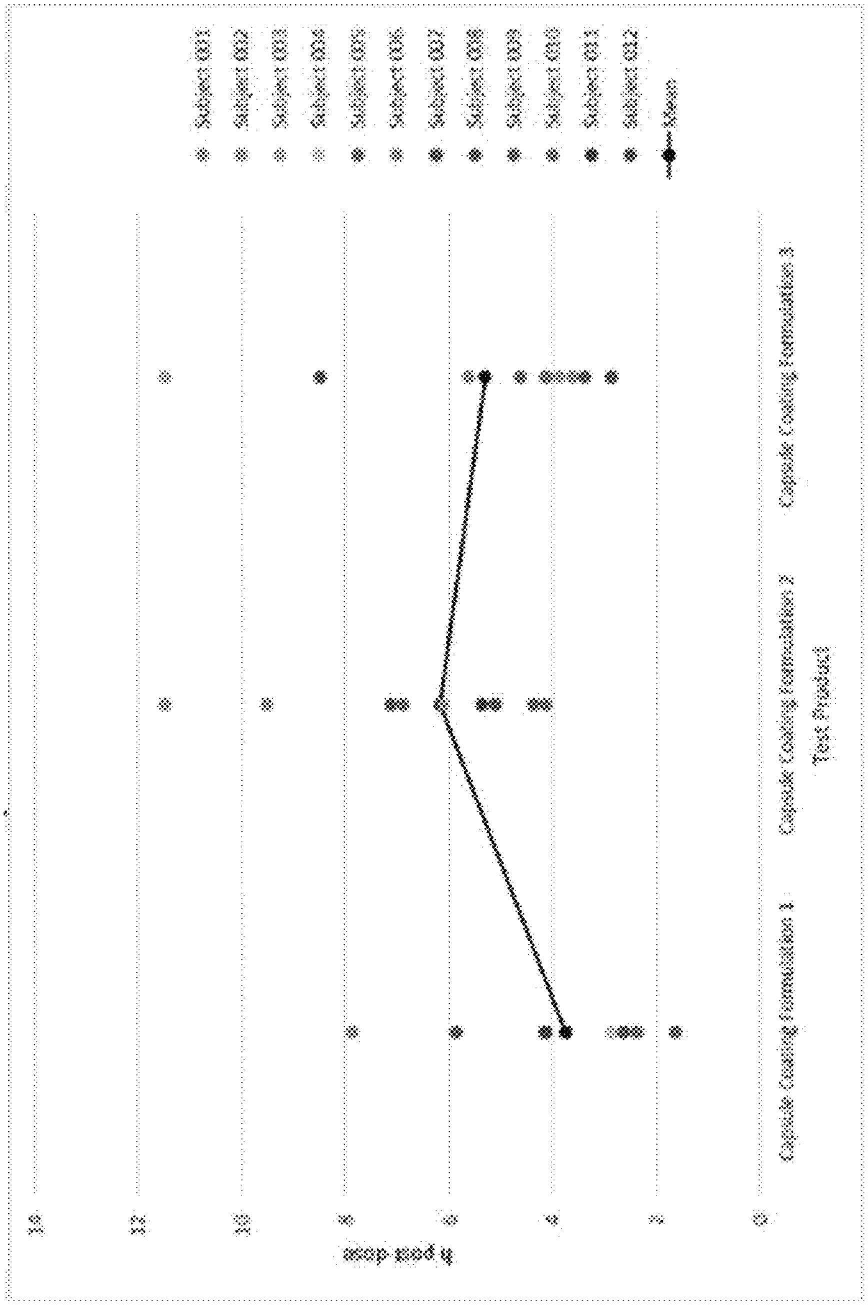
Figure 33A:
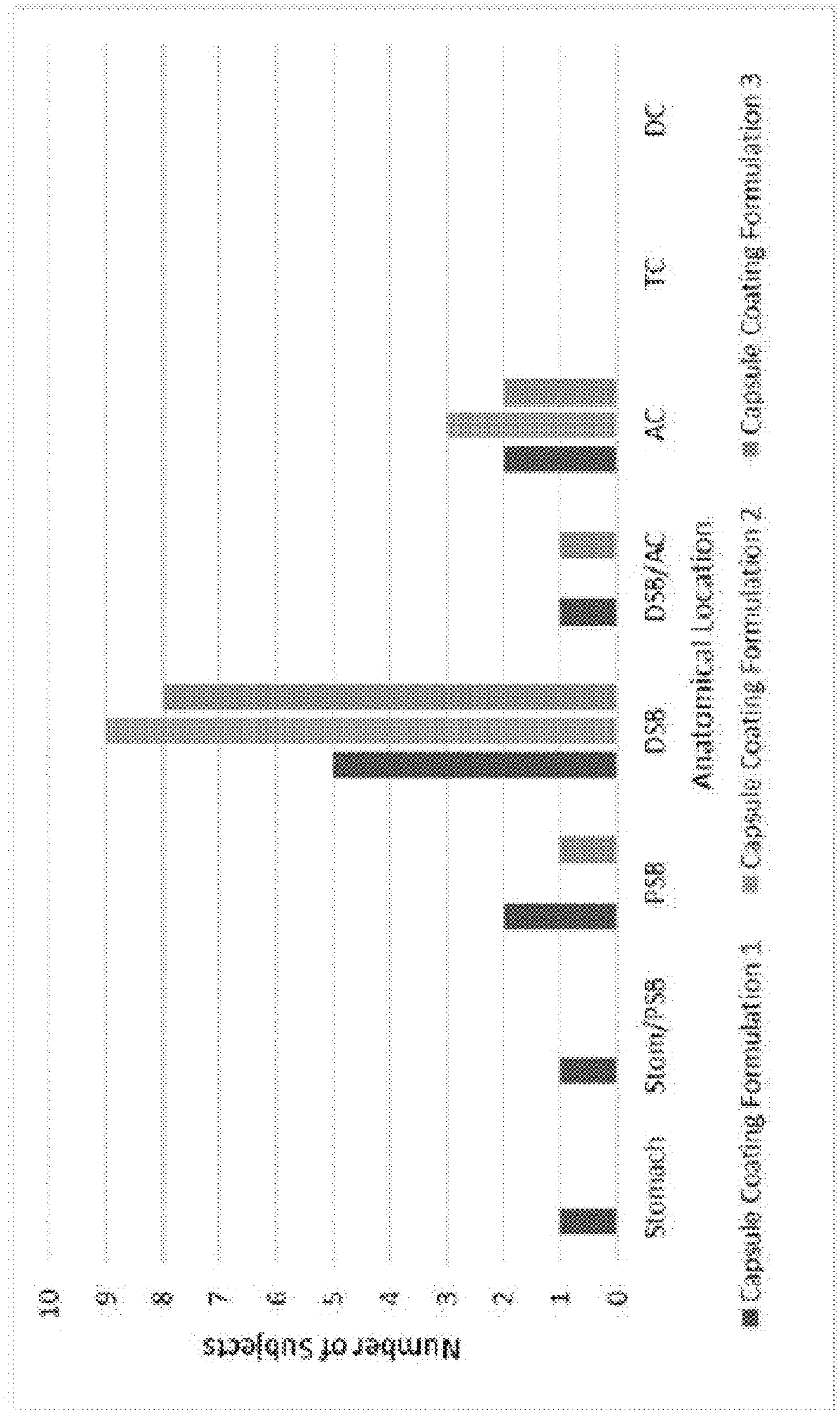
FIGS. 33A-33B illustrate anatomical location of radiolabel release from capsules with a coating of formulation 1, 2, or 3, as described in TABLE 35.
Figure 33B:
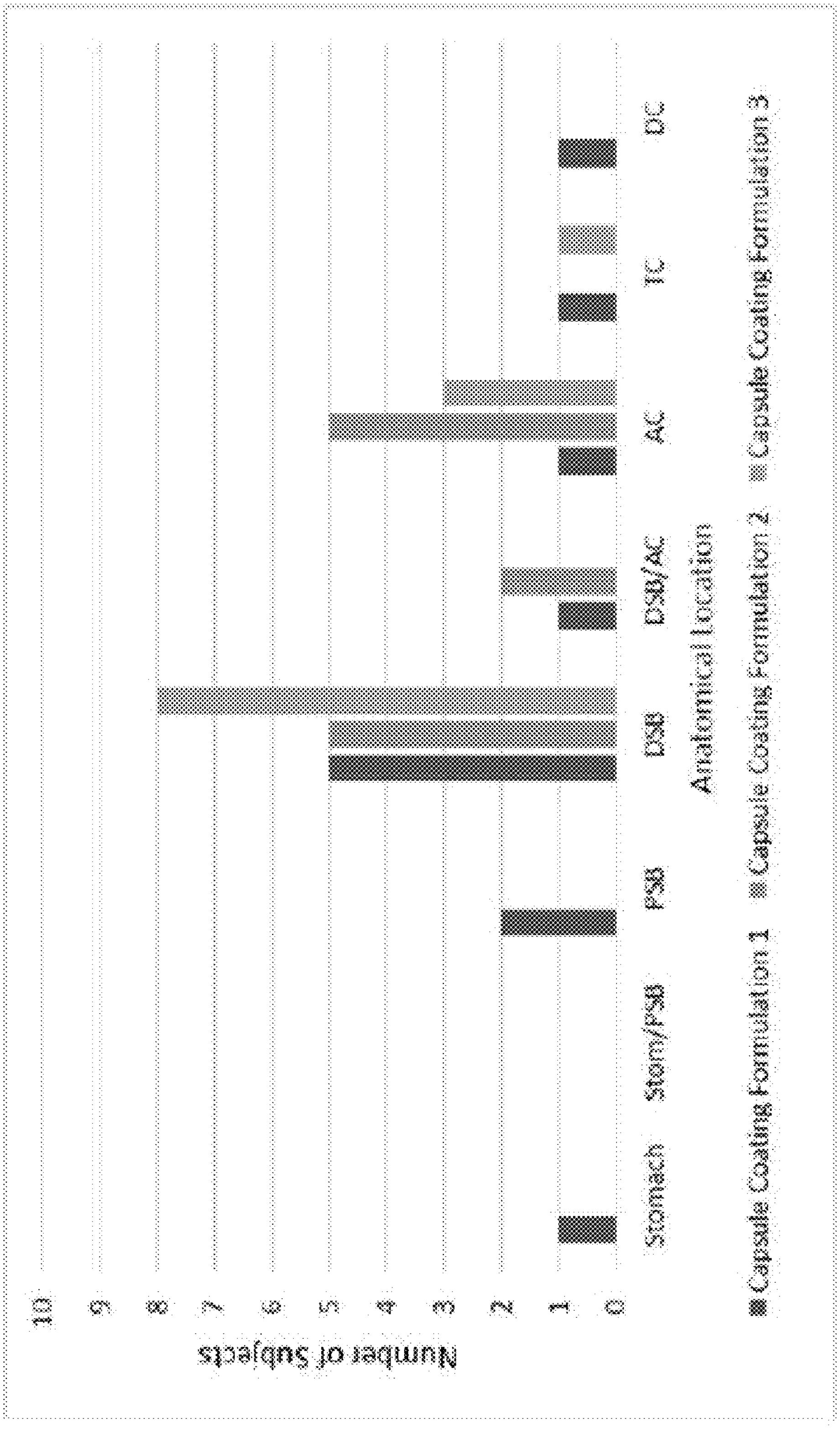

Following administration with capsule coating formulation 1, initial radiolabel release was observed with a mean value of 2.675 h post-dose (TABLES 36,37; FIG. 32A). Complete radiolabel release was achieved approximately 1.1 h later, at a mean time of 3.758 h post-dose (TABLES 36, 37; FIG. 32B). Anatomical locations of disintegration were noted to be highly variable, ranging from the stomach to the ascending colon (AC) for initial (FIG. 33A), and to the descending colon (DC) for complete release (FIG. 33B).

Following administration with capsule coating formulation 2, initial radiolabel release was observed with a mean value of 4.903 h post-dose (TABLES 36, 38; FIG. 32A). Similar to capsule coating formulation 1, complete radiolabel release occurred approximately 1.3 h later, with a mean time of 6.176 h post-dose (TABLES 36,38; FIG. 32B). Anatomical locations of initial (FIG. 33A) and complete (FIG. 33B) disintegration displayed less variation, with all radiolabel release occurring between the distal small bowel (DSB) and the AC.

Following administration with capsule coating formulation 3, initial radiolabel release occurred at a slightly earlier time than capsule coating formulation 2 at 4.082 h post-dose (TABLES 36, 39; FIG. 32A). Similar to capsule coating formulations 1 and 2, complete radiolabel release was noted to occur approximately 1.2 h later, with a mean time of 5.308 h post-dose (TABLES 36, 39; FIG. 32B). Anatomical locations of disintegration were less variable then those for capsule coating formulation 1, albeit more variable than those noted for capsule coating formulation 2. Initial release ranged from the proximal small bowel (PSB) to the AC (FIG. 33A), while complete release ranged from the DSB to the transvers colon (TC) (FIG. 33B).

TABLE 36

Qualitative scintigraphic parameters for the time and location of initial and complete radiolabel release in healthy volunteers following administration of oral capsule coating formulations.

| | Initial Radiolabel Release * (h post-dose) | Initial Location Category[a] (n) | Complete Radiolabel Release * (h post-dose) | Complete Location Category[a] (n) | Duration of Disintegration (h) |
|---|---|---|---|---|---|
| Regimen A Capsule Coating Formulation 1 (N = 12) | 2.675 (1.140) | Stomach (n = 1)<br>Stomach/PSB (n = 1)<br>PSB (n = 2)<br>DSB (n = 5)<br>DSB/AC (n = 1)<br>AC (n = 2) | 3.758 (1.736) | Stomach (n = 1)<br>PSB (n = 2)<br>DSB (n = 5)<br>DSB/AC (n = 1)<br>AC (n = 1)<br>TC (n = 1)<br>DC (n = 1) | 1.083 (0.857) |

TABLE 36-continued

Qualitative scintigraphic parameters for the time and location of initial and complete radiolabel release in healthy volunteers following administration of oral capsule coating formulations.

| | Initial Radiolabel Release * (h post-dose) | Initial Location Category[a] (n) | Complete Radiolabel Release * (h post-dose) | Complete Location Category[a] (n) | Duration of Disintegration (h) |
|---|---|---|---|---|---|
| Regimen B Capsule Coating Formulation 2 (N = 12) | 4.903 (1.298) | DSB (n = 9) AC (n = 3) | 6.176 (2.289) | DSB (n = 5) DSB/AC (n = 2) AC (n = 5) | 1.273 (1.444) |
| Regimen C Capsule Coating Formulation 3 (N = 12) | 4.082 (1.769) | PSB (n = 1) DSB (n = 8) DSB/AC (n = 1) AC (n = 2) | 5.308 (2.738) | DSB (n = 8) AC (n = 3) TC (n = 1) | 1.226 (1.454) |

* Mean (±SD)

[a]Location categories defined from: Stomach, Proximal small bowel (PSB), Distal small bowel (DSB), Ascending colon (AC; including the hepatic flexure), Transverse colon (TC; including the splenic flexure), Descending colon (DC; including the sigmoid colon and rectum). Where it is not possible to specify the exact location, a joint location category has been used.

TABLE 37

Qualitative scintigraphic parameters in healthy volunteers following administration of oral capsule coating formulation 1 (Regimen A)

| Subject number | Initial radiolabel release (h post-dose) | Anatomical position of capsule at time of initial release [a] | Complete radiolabel release (h post-dose) | Anatomical position of capsule at time of complete release [a] | Duration of disintegration (h) |
|---|---|---|---|---|---|
| 001 | 2.63 | PSB | 4.13 | DSB | 1.50 |
| 002 | 1.63 | DSB | 2.88 | DSB | 1.25 |
| 003 | 2.14 | DSB | 2.39 | DSB | 0.25 |
| 004 | 2.38 | PSB | 2.88 | PSB | 0.50 |
| 005 | 2.13 | Stomach | 2.38 | Stomach | 0.25 |
| 006 | 5.13 | AC | 7.88 | DC | 2.75 |
| 007 | 3.88 | AC | 4.13 | AC | 0.25 |
| 008 | 4.13 | DSB/AC | 5.88 | TC | 1.75 |
| 009 | 1.38 | Stom/PSB | 1.63 | PSB | 0.25 |
| 010 | 2.88 | DSB | 4.13 | DSB | 1.25 |
| 011 | 1.89 | DSB | 4.15 | DSB/AC | 2.26 |
| 012 | 1.90 | DSB | 2.64 | DSB | 0.74 |
| Mean | 2.675 | | 3.758 | | 1.083 |
| SD | 1.140 | | 1.736 | | 0.857 |
| Median | 2.260 | | 3.505 | | 0.995 |
| Min | 1.38 | | 1.63 | | 0.25 |
| Max | 5.13 | | 7.88 | | 2.75 |
| n= | 12 | | 12 | | 12 |

[a] Location categories defined from: Stomach, Proximal small bowel (PSB), Distal small bowel (DSB), Ascending colon (AC; including the hepatic flexure), Transverse colon (TC; including the splenic flexure), Descending colon (DC; including the sigmoid colon and rectum). Where it is not possible to specify the exact location, a joint location category has been used.

TABLE 38

Qualitative scintigraphic parameters in healthy volunteers following administration of oral capsule coating formulation 2 (Regimen B)

| Subject number | Initial radiolabel release (h post-dose) | Anatomical position of capsule at time of initial release [a] | Complete radiolabel release (h post-dose) | Anatomical position of capsule at time of complete release [a] | Duration of disintegration (h) |
|---|---|---|---|---|---|
| 001 | 5.88 | AC | 6.13 | AC | 0.25 |
| 002 | 6.88 | AC | 11.50 | AC | 4.62 |
| 003 | 3.13 | DSB | 4.38 | AC | 1.25 |
| 004 | 4.14 | DSB | 4.40 | DSB | 0.26 |
| 005 | 6.14 | DSB | 6.89 | DSB | 0.75 |
| 006 | 5.88 | DSB | 9.53 | DSB/AC | 3.65 |

TABLE 38-continued

Qualitative scintigraphic parameters in healthy volunteers following administration of oral capsule coating formulation 2 (Regimen B)

| Subject number | Initial radiolabel release (h post-dose) | Anatomical position of capsule at time of initial release [a] | Complete radiolabel release (h post-dose) | Anatomical position of capsule at time of complete release [a] | Duration of disintegration (h) |
|---|---|---|---|---|---|
| 007 | 4.38 | DSB | 5.13 | DSB | 0.75 |
| 008 | 4.38 | DSB | 5.13 | DSB | 0.75 |
| 009 | 4.13 | DSB | 4.38 | DSB/AC | 0.25 |
| 010 | 3.88 | DSB | 4.13 | DSB | 0.25 |
| 011 | 3.39 | DSB | 5.38 | AC | 1.99 |
| 012 | 6.63 | AC | 7.13 | AC | 0.50 |
| Mean | 4.903 | | 6.176 | | 1.273 |
| SD | 1.298 | | 2.289 | | 1.444 |
| Median | 4.380 | | 5.255 | | 0.750 |
| Min | 3.13 | | 4.13 | | 0.25 |
| Max | 6.88 | | 11.50 | | 4.62 |
| n= | 12 | | 12 | | 12 |

[a] Location categories defined from: Stomach, Proximal small bowel (PSB), Distal small bowel (DSB), Ascending colon (AC; including the hepatic flexure), Transverse colon (TC; including the splenic flexure), Descending colon (DC; including the sigmoid colon and rectum). Where it is not possible to specify the exact location, a joint location category has been used.

TABLE 39

Qualitative scintigraphic parameters in healthy volunteers following administration of oral capsule coating formulation 3 (Regimen C)

| Subject number | Initial radiolabel release (h post-dose) | Anatomical position of capsule at time of initial release [a] | Complete radiolabel release (h post-dose) | Anatomical position of capsule at time of complete release [a] | Duration of disintegration (h) |
|---|---|---|---|---|---|
| 001 | 5.63 | DSB | 5.63 | DSB | 0.00 |
| 002 | 3.64 | DSB | 3.88 | DSB | 0.24 |
| 003 | 8.50 | AC | 11.50 | TC | 3.00 |
| 004 | 5.38 | DSB | 8.50 | DSB | 3.12 |
| 005 | 3.88 | DSB | 4.63 | DSB | 0.75 |
| 006 | 3.38 | AC | 3.63 | AC | 0.25 |
| 007 | 4.15 | DSB/AC | 8.51 | AC | 4.36 |
| 008 | 1.88 | DSB | 3.38 | DSB | 1.50 |
| 009 | 3.65 | DSB | 4.14 | AC | 0.49 |
| 010 | 3.88 | DSB | 4.13 | DSB | 0.25 |
| 011 | 2.63 | PSB | 2.88 | DSB | 0.25 |
| 012 | 2.38 | DSB | 2.88 | DSB | 0.50 |

TABLE 39-continued

| Qualitative scintigraphic parameters in healthy volunteers following administration of oral capsule coating formulation 3 (Regimen C) | | | | | |
|---|---|---|---|---|---|
| Subject number | Initial radiolabel release (h post-dose) | Anatomical position of capsule at time of initial release [a] | Complete radiolabel release (h post-dose) | Anatomical position of capsule at time of complete release [a] | Duration of disintegration (h) |
| Mean | 4.082 | | 5.308 | | 1.226 |
| SD | 1.769 | | 2.738 | | 1.454 |
| Median | 3.765 | | 4.135 | | 0.495 |
| Min | 1.88 | | 2.88 | | 0.00 |
| Max | 8.50 | | 11.50 | | 4.36 |
| n= | 12 | | 12 | | 12 |

[a] Location categories defined from: Stomach, Proximal small bowel (PSB), Distal small bowel (DSB), Ascending colon (AC; including the hepatic flexure), Transverse colon (TC; including the splenic flexure), Descending colon (DC; including the sigmoid colon and rectum). Where it is not possible to specify the exact location, a joint location category has been used.

Example 14: Assessment of Efficacy of an IL-10 Delivery Construct in an Oxazolone-Induced Mouse Model of Th2 Ulcerative Colitis The inflammatory bowel diseases (IBD), Crohn's disease (CD) and ulcerative colitis (UC), are chronic relapsing disorders characterized by inflammation of the gastrointestinal (GI) tract. IBD patients suffer from progressive and debilitating symptoms resulting from a complex interaction of genetic contribution, environmental factors and an inappropriate host inflammatory response to luminal antigens, elicited by the mucosal immune system.

Cytokines control numerous aspects of the immune response involved in establishing and/or maintaining a proinflammatory or anti-inflammatory bias that control many aspects of health and disease. Along the gastrointestinal (GI) tract, immunomodulatory cells respond to a wide variety of environmental stimuli and are responsible for initiating a proinflammatory signaling cascade in response to pathological antigens. Epithelial cells and cells localized to the underlying lamina propria of the GI tract respond to a myriad of cytokines that control the inflammatory status of this tissue. In the case of GI-related IBD, including UC and CD, activation of pro-inflammatory pathways appears to occur too readily and the resolution of these events, to maintain GI homeostasis, is insufficient. Thus, the onset, progression, and resolution of IBD conditions are regulated by the balance of proinflammatory and anti-inflammatory cytokines. By manipulating GI-associated, proinflammatory cytokines through the actions of environmental insults, it is possible to establish pre-clinical animal models that re-create many pathophysiological aspects observed in IBD patients.

Oxazolone-induced murine colitis represents a reliable system to evaluate potential treatments for IBD where an environmental insult is used to incite an acute inflammatory condition. It is characterized by a mixed neutrophil and lymphocyte infiltration limited to the superficial layer of the mucosa, which is associated with ulceration. In this model, peripheral pre-sensitization is followed by rectal instillation of the haptenizing agent, oxazolone. This sensitization/activation protocol leads to a Th2-mediated immune response that is marked by an increase in tissue interleukin (IL)-4 and IL-5 secretion, reflecting distinguishing molecular hallmarks of UC. Importantly, oxazolone exposure also increases other tissue cytokines that play a role in inflammation, including the chemokines monocyte chemoattractant protein (MCP)-1, macrophage inflammatory protein (MIP)-1β, growth factor granulocyte-colony stimulating factor (G-CSF) and the proinflammatory cytokines tumor necrosis factor (TNF)-α and IL-1α. Systemic concentrations of proinflammatory cytokines and chemokines are generally also elevated in IBD patients; specifically, TNF-α secretion may correlate with disease severity. Thus, sampling of plasma cytokines can reflect intestinal inflammation and drug efficacy as well as assist in elucidating the mechanism of action for a drug.

The objectives of this study were to: (1) evaluate the ability of an IL-10 delivery construct (SEQ ID NO: 5) solution, delivery by oral gavage, to prevent oxazolone-induced colitis in mice by assessing multiple-in-life disease parameters (body weight loss, stool consistency, hemoccult), survivability, post-necropsy colon morphology (weight and length) and colon histopathology at study termination; (2) assess the anti-inflammatory efficacy and mechanism of the IL-10 delivery construct (SEQ ID NO: 5) in isolated intestinal tissue through immunohistochemical staining of colonic TNF-α, NFκB, IL-4, CD4 and Foxp3; and (3) assess the anti-inflammatory actions of the IL-10 delivery construct (SEQ ID NO: 5) by measuring plasma concentrations of cytokines and chemokines using the Luminex and Meso Scale Discovery (MSD) platforms.

Methods

Female SJL/J mice were obtained from The Jackson Laboratory, Bar Harbor, Me. 04609 USA. At the commencement of the study, mice were between 7-8 weeks of age, weighing 18-22 g. Mice were maintained in a controlled environment with a temperature of 70-72° F., humidity 30-70%, and photo cycle of 12 hours of light and 12 hours of dark. Mice were provided with TEKLAD 2018-Global 18% diet and Arrowhead drinking water ad libitum. Mice were acclimatized for a period of seven days.

Colitis induction and treatment in mice were conducted by Invitek Inc. (Hayward, Calif.). Mice were pre-sensitized with a 3% oxazolone (Sigma Aldrich, USA; catalog #: E0753) in 100% ethanol on a patch of dorsal skin at day −5 and intra-rectally challenged with a 1% oxazolone in 40% ethanol on day 0. Control mice (Naïve) were treated with 100% (day −5) and 40% ethanol (day 0). Mice were treated q.d. by oral gavage (10 mL/kg) of the IL-10 delivery construct (SEQ ID NO:5) (8.45 mg/kg), aminosalicylate (5-ASA, 100 mg/kg, dissolved in water; Sigma Aldrich, USA; Catalog #: A3537) or Vehicle control for the IL-10 delivery construct from day −5 through day 6. Experimental design and group numbers are summarized in TABLE 40. Daily body weight and disease parameters (fecal consistency, hemoccult positivity) were recorded to generate a disease activity index (DAI). Plasma and colon tissue were collected at study termination on day 7. Colon weights and lengths were measured prior to fixation.

TABLE 40

| Experimental design | | | | | | |
|---|---|---|---|---|---|---|
| Group | Description | N | Route of administration | Dose (mg/kg) | Dose volume (ml/kg) | Dosing frequency |
| 1 | Control, no oxazolone (Naïve) | 5 | p.o. | n/a | 10 | q.d., Day-5-+6 |
| 2 | Oxazolone treatment + oral gavage Vehicle (Vehicle) | 10 | p.o. | n/a | 10 | q.d., Day-5-+6 |

TABLE 40-continued

| Experimental design | | | | | | |
|---|---|---|---|---|---|---|
| Group | Description | N | Route of adminis-tration | Dose (mg/kg) | Dose volume (ml/kg) | Dosing frequency |
| 3 | IL-10 delivery construct | 15 | p.o. | 8.45 | 10 | q.d., Day-5-+6 |
| 4 | 5-ASA | 15 | p.o. | 100 | 10 | q.d., Day-5-+6 |

Hematoxylin and eosin staining of formalin-fixed and paraffin-embedded cross sections of approximate proximal, mid, and distal colon and their histopathology scoring were performed by IDEXX Reference Laboratories, Inc. The presence of colitis and severity score was assessed according to the presence of inflammation, leukocyte infiltration, vascular density, colon wall thickness, crypt abscesses and the presence of goblet cells and ulceration.

Formalin-fixed and paraffin-embedded cross sections of the proximal, mid, and distal colon regions (2 sections each) of treated mice were processed for IHC staining of mouse NF-kB p65, TNF-α, IL-4, CD4, Foxp3 by HistoTox (Boulder, Colo.). Image analysis was performed on the digital slide images using Visiopharm software, using the following procedure. The tissues were processed using imaging filters in order to separate positive staining from counterstaining, then processed images were classified using a thresholding method, where a threshold is established based on pixel values associated with positively stained tissues. Quantification of the amount of positive staining was determined by analyzing the labeled image; percent positivity was calculated by dividing the area of positive tissue by the total tissue area to provide a metric for positivity.

Plasma cytokines were quantified using the V-plex Proinflammatory Panel 1 Mouse Kit. Plasma IL-1Ra was quantitated by sandwich immunoassay using an antibody pair from the Mouse IL-1Ra/IL-1F3 DuoSet ELISA (R&D Systems #DY480), Streptavidin SULFO-TAG Labeled (MSD #R32AD-1), Multi-Array 96 Plate Pack, SECTOR Plate MSD #L15XA-3 and Read Buffer T (4×) (MSD #R92TC-2). Samples were read on the QuickPlex SQ 120 plate reader (Meso Scale Discovery, Rockville, Md.).

The Luminex assay was performed in the Human Immune Monitoring Center at Stanford University. Mouse 38 plex kits were purchased from eBiosciences/Affymetrix and used according to the manufacturer's recommendations with modifications as described herein. Beads were added to a 96-well plate and washed in a Biotek ELx405 washer. Samples were added to the plate containing the mixed antibody-linked beads and incubated at room temperate for 1 hour followed by overnight incubation at 4° C. with shaking. Cold and room temperature incubation steps were performed on an orbital shaker at 500-600 rpm. Following the overnight incubation plates were washed in a Biotek ELx405 washer and then biotinylated detection antibody added for 75 minutes at room temperature with shaking. Plates were washed as above and streptavidin-PE was added. After incubation for 30 minutes at room temperature, washing was performed as above and reading buffer was added to the wells. Each sample was measured in duplicate. Plates were read using a Luminex 200 instrument with a lower bound of 50 beads per sample per cytokine. Custom assay control beads by Radix Biosolutions were added to all wells.

Statistical analyses were performed using Prism 5.0 (Invitek data) or Prism 7.0 (GraphPad Software, Inc.). Data were analyzed using one-way ANOVA or two-way ANOVA followed by Bonferroni, Tukey or Dunnett post-hoc tests. P values <0.05 were considered significant.

Results

Figure 35:
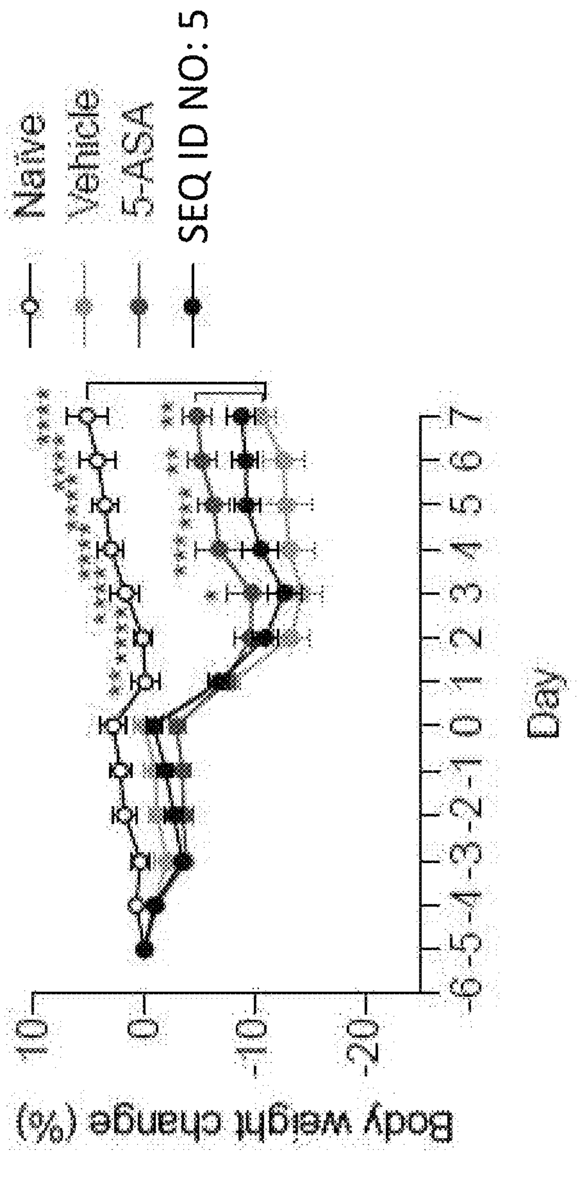
FIG. 35 illustrates the effect of the IL-10 delivery construct (SEQ ID NO: 5) on percentage change in body weight in mice following oxazolone-induced colonic inflammation. Body weight was recorded daily in mice preceding and following the insult. Data are expressed as mean SEM; n per group: naive (5), vehicle (10), IL-10 delivery construct (15), 5-ASA (15). Data were analyzed by 2-way ANOVA with Dunnett's post-hoc test to compare difference of each group vs. vehicle at each day. *p<0.05, p<0.01, *p<0.001, ****p<0.0001.
Figure 36:
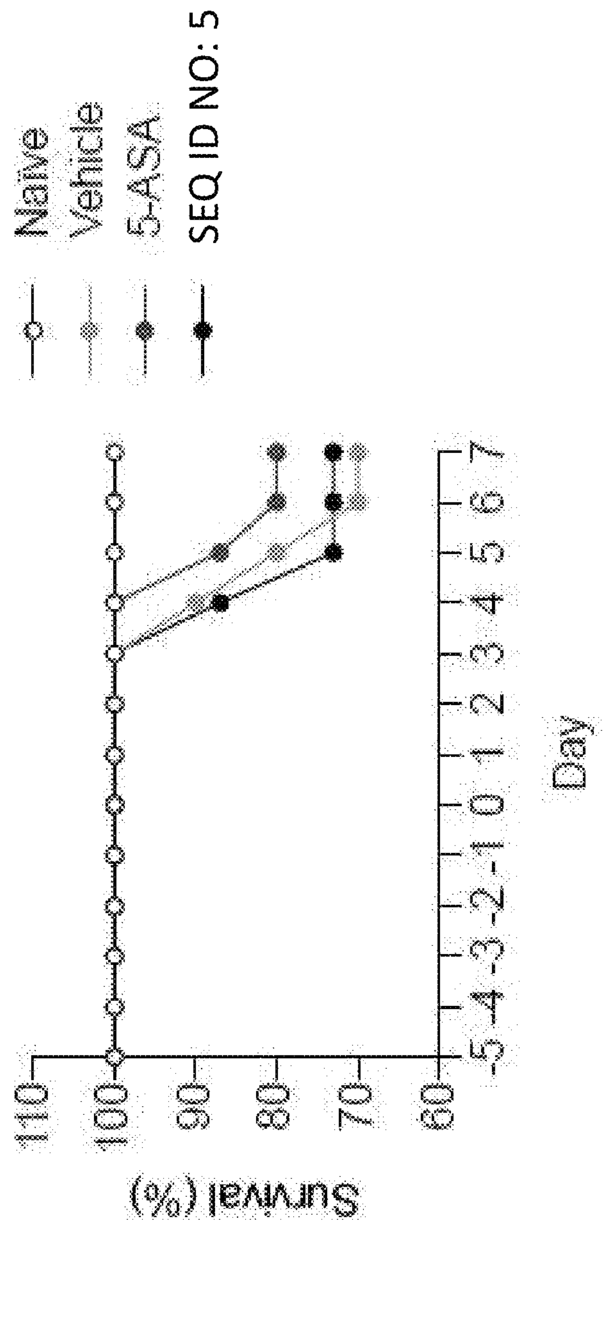
FIG. 36 illustrates the effect of the IL-10 delivery construct (SEQ ID NO: 5) on survival rates in mice following oxazolone-induced colonic inflammation. Mortality was recorded daily in mice preceding and following the insult. Data are expressed as percentage survival.
Figure 37:
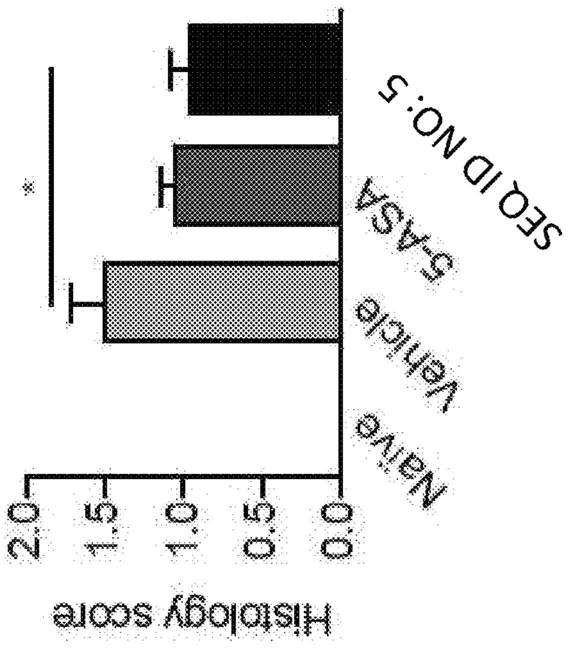
FIG. 37 illustrates the effect of the IL-10 delivery construct (SEQ ID NO: 5) on disease severity in mice following oxazolone-induced colonic inflammation. Severity was assessed by colonic markers of inflammation 7 days after the insult.
Figure 38A:
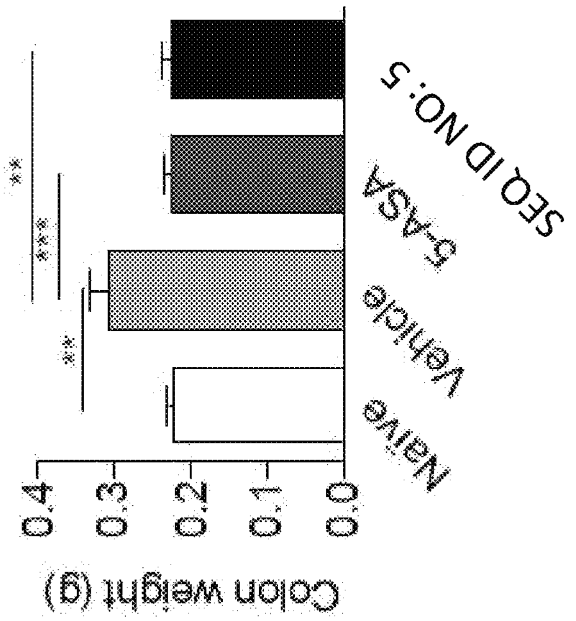
FIG. 38A illustrates the effect of the IL-10 delivery construct (SEQ ID NO: 5) on colon weight in mice following oxazolone-induced colonic inflammation. Colon weight was measured 7 days after the insult.
Figure 38C:
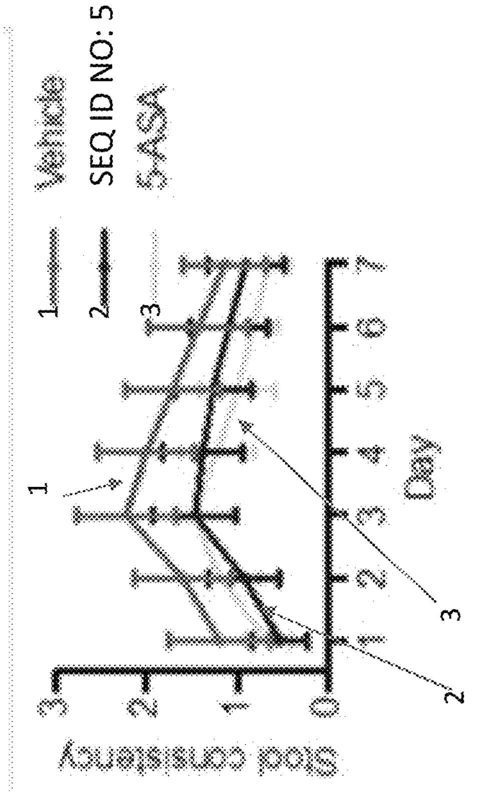
FIG. 38C illustrates the effect of the IL-10 delivery construct (SEQ ID NO: 5) on stool consistency in mice following oxazolone-induced colonic inflammation.
Figure 38B:
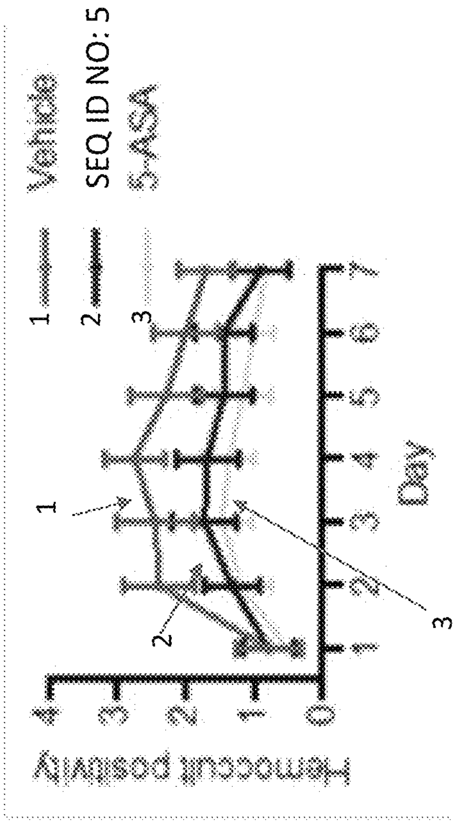
FIG. 38B illustrates the effect of the IL-10 delivery construct (SEQ ID NO: 5) on hemoccult positivity in mice following oxazolone-induced colonic inflammation.
Figure 38D:
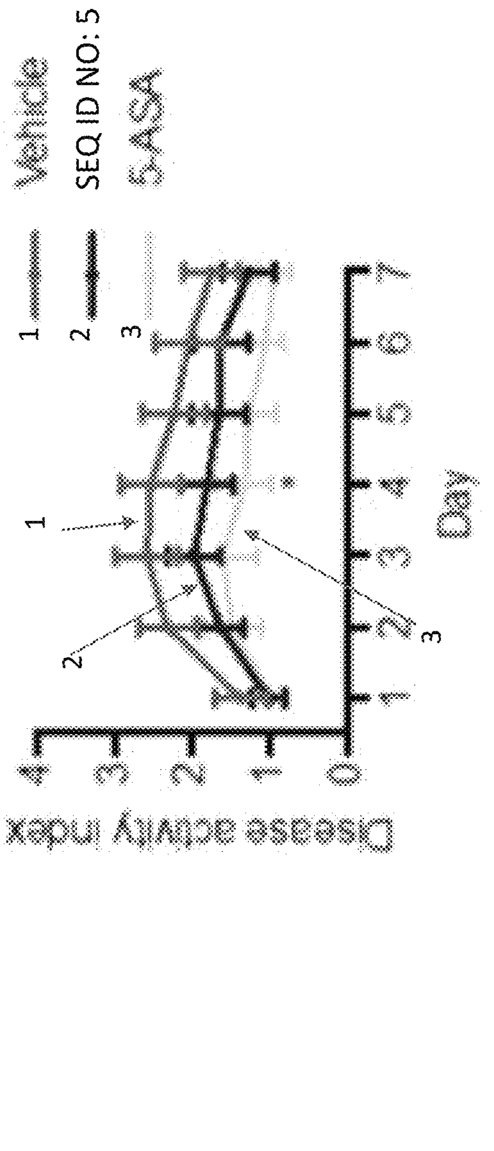
FIG. 38D illustrates the effect of the IL-10 delivery construct (SEQ ID NO: 5) on disease activity index in mice following oxazolone-induced colonic inflammation.
Figure 38G:
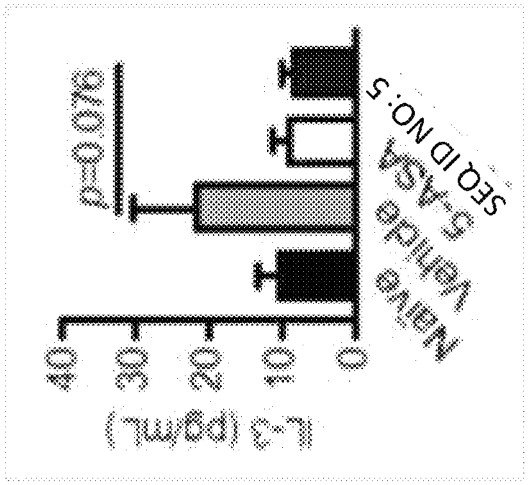
FIG. 38G illustrates the effect of the IL-10 delivery construct (SEQ ID NO: 5) on serum levels of IL-3 in mice following oxazolone-induced colonic inflammation.
Figure 38F:
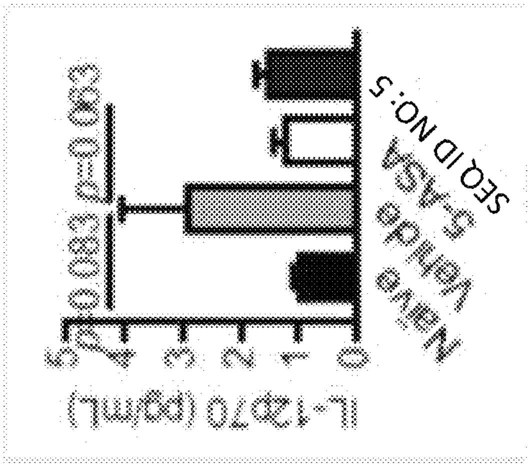
FIG. 38F illustrates the effect of the IL-10 delivery construct (SEQ ID NO: 5) on serum levels of IL12 p70 protein in mice following oxazolone-induced colonic inflammation.
Figure 38E:
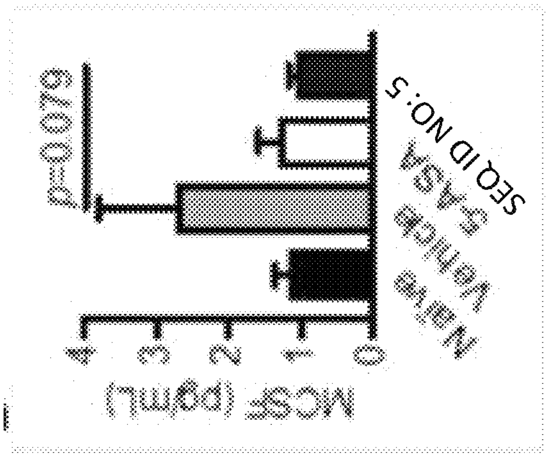
FIG. 38E illustrates the effect of the IL-10 delivery construct (SEQ ID NO: 5) on serum levels of macrophage colony-stimulating factor 1 (MCSF) in mice following oxazolone-induced colonic inflammation.
Figure 39C:
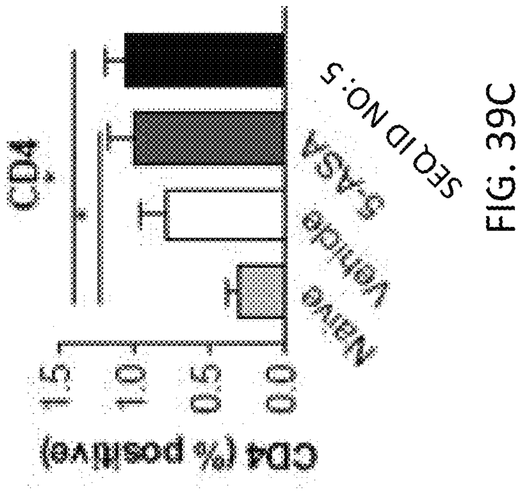
FIGS. 39A-39E illustrates effects of oral IL-10 delivery construct administration on cellular expression of proteins relevant to the inflammatory processes associated with ulcerative colitis. Cross-sections from the proximal, mid, and distal colon from mice following oxazolone-induced colonic inflammation were analyzed by immunohistochemistry.
Figure 39B:
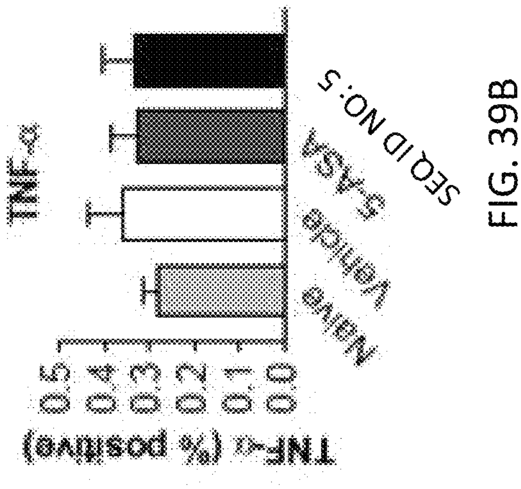
Figure 39A:
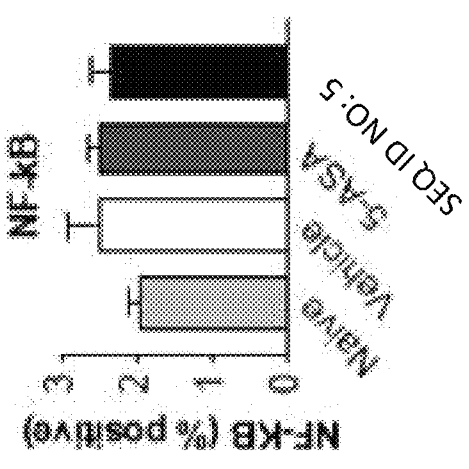
Figure 39E:
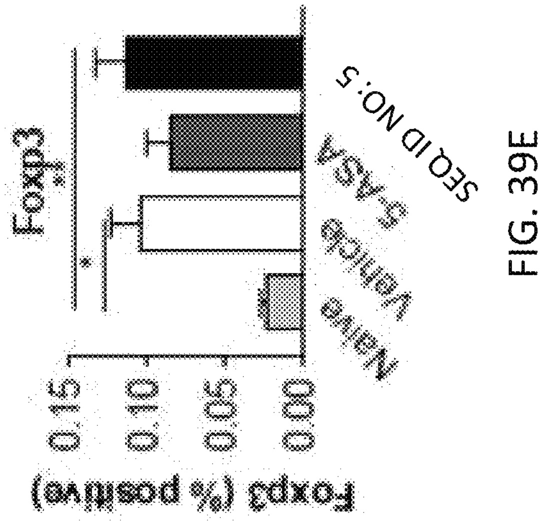
Figure 39D:
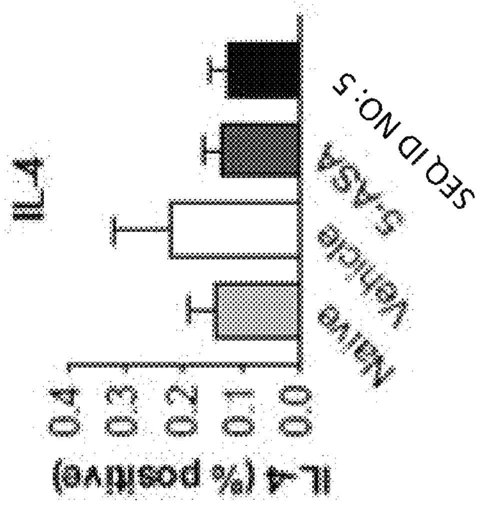

Oxazolone-induced colonic inflammation was associated with a significant reduction in body weight and reduced survivability (Vehicle control vs. Naïve control groups; FIG. 35 and FIG. 36). This decrease in body weight was found to be attenuated by treatment with 5-ASA ($p<0.05$ at days 4-7); however no statistical differences were detected in mice receiving the IL-10 delivery construct (FIG. 35). The IL-10 delivery construct treatment improved survival relative to Vehicle (3% increase), whereas 5-ASA treatment led to a more pronounced improvement in survival (10%), (FIG. 36). No differences were detected in stool consistency or hemoccult positivity (presence of blood in stool) between any of the groups (data not shown). Oxazolone treatment induced colonic inflammation in Vehicle-treated mice, as indicated by the histopathological severity score, which was attenuated by treatment with the IL-10 delivery construct ($p<0.05$; Vehicle vs. IL-10 delivery construct), but not 5-ASA treatment (FIG. 37). Oxazolone treatment also significantly increased colon weight in the Vehicle group, which was ameliorated by the presence of both the IL-10 delivery construct and 5-ASA ($p<0.01$ and $p<0.001$ respectively), (FIG. 38A). Compared to vehicle-treated animals, improvements for treatment with the delivery construct were observed for hemoccult positivity (FIG. 38B), stool consistency (FIG. 38C), and disease activity index (FIG. 38D). Treatment-mediated suppression of increased serum levels of macrophage colony-stimulating factor 1 (MCSF, FIG. 38E), IL12 p70 protein (FIG. 38F), and IL-3 (FIG. 38G) was observed.

NFκB is a transcription factor that plays a chief role in inflammation; signaling through NFκB regulates the proinflammatory cytokines IL-10, IL-6 and TNF-α. To understand the local effect of the IL-10 delivery construct, protein expression of TNF-α, NF-kB, IL-4, CD4, and Foxp3 was analyzed in colon sections by IHC (FIGS. 39A-39E). Inflammation induced by oxazolone (represented by the Vehicle treatment group) led to a trend towards an increased number of cells in the colon expressing CD4. This data indicated the presence of a greater number of activated CD4+ T cells, which may include Th2 effector cells, the main driver of inflammation in this model. Foxp3 expression was also found to be increased in the Vehicle group (356%, relative to Naïve animals). However, like 5-ASA, treatment with the IL-10 delivery construct did not elicit any significant effect on the expression of any of the proteins investigated.

To further evaluate IL-10 delivery construct efficacy and understand its mechanisms of action, circulating concentrations of 38 chemokines, growth factors, anti-inflammatory cytokines, and proinflammatory cytokines were determined using the Luminex array. Oxazolone-induced colitis (Vehicle group) did not result in statistically-significant changes in plasma levels of these molecules compared to animals not exposed to oxazolone (Naïve group). However, a trend was observed for increased plasma levels of the proinflammatory cytokines IL-6 and IL-23 (FIGS. 40A-40B) in animals with oxazolone-induced colitis compared with the Naïve group; plasma levels of these cytokines are elevated in IBD.

Figure 40A:
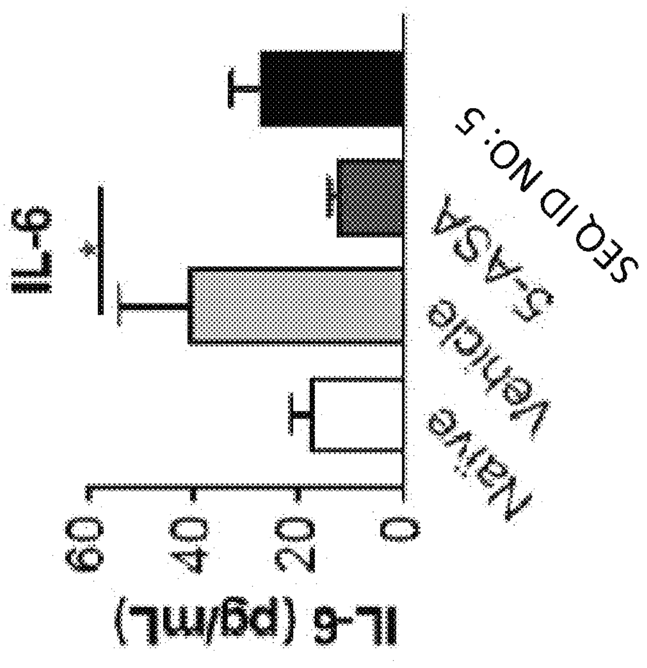
FIGS. 40A-40B illustrate a Luminex array of systemic cytokines following oral delivery of an IL-10 delivery construct dosing solution.
Figure 40B:
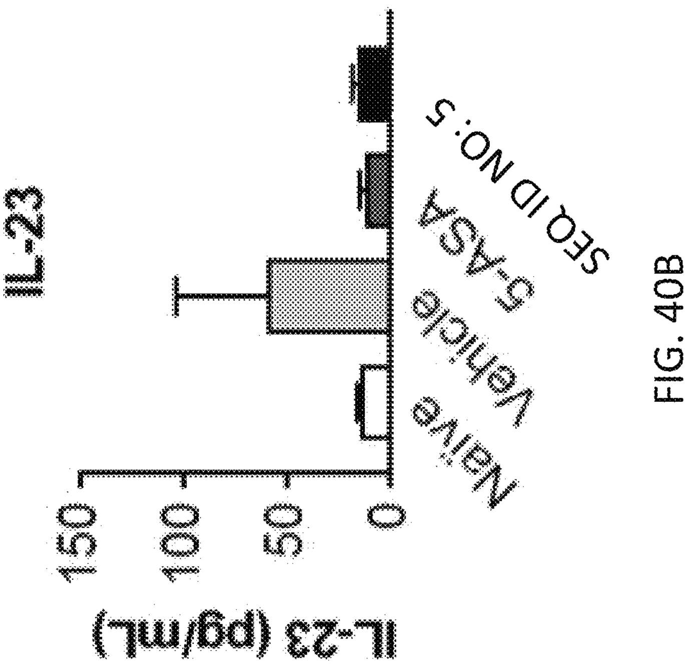
Figure 41C:
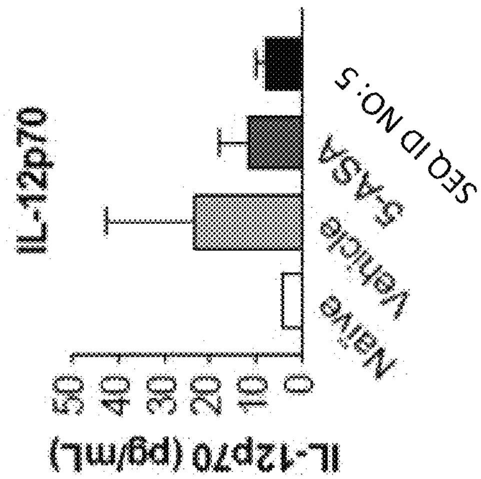
FIGS. 41A-41J illustrate concentration of 10 cytokines in plasma samples using MSD Proinflammatory Panel 1 following the indicated treatments.
Figure 41B:
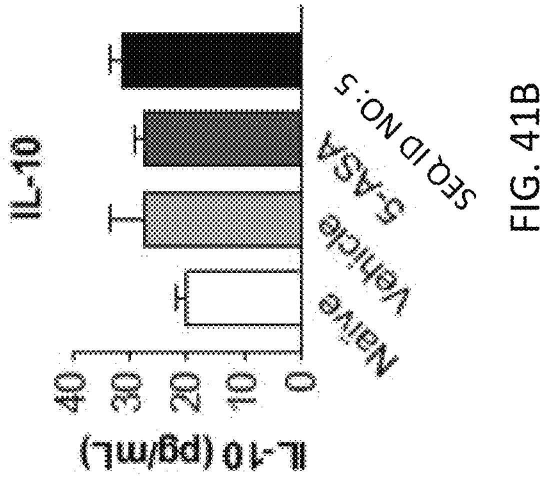
Figure 41A:
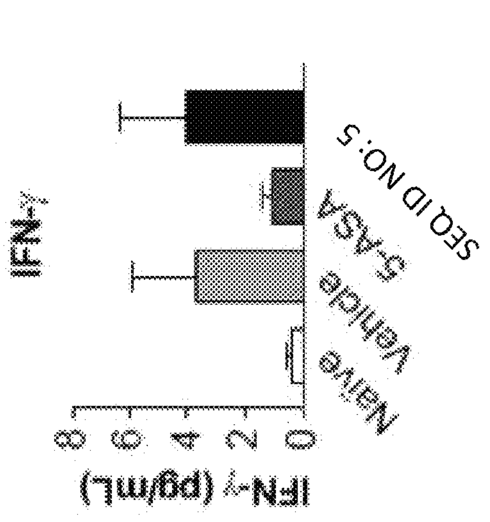
Figure 41E:
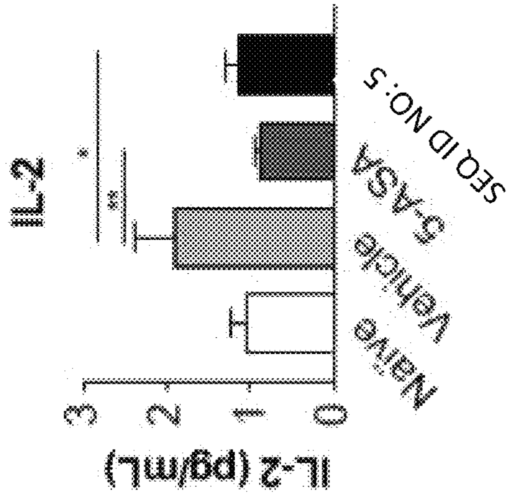
Figure 41D:
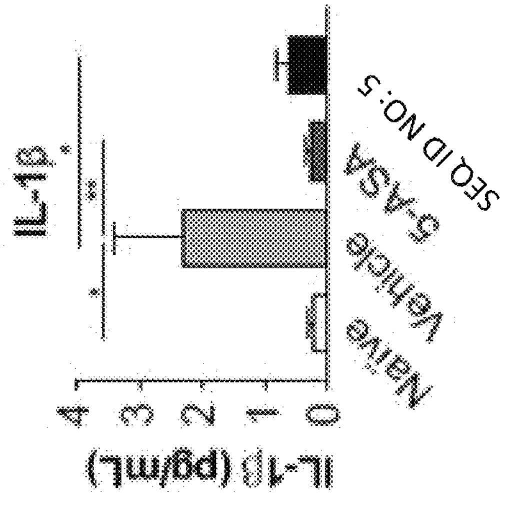
Figure 41F:
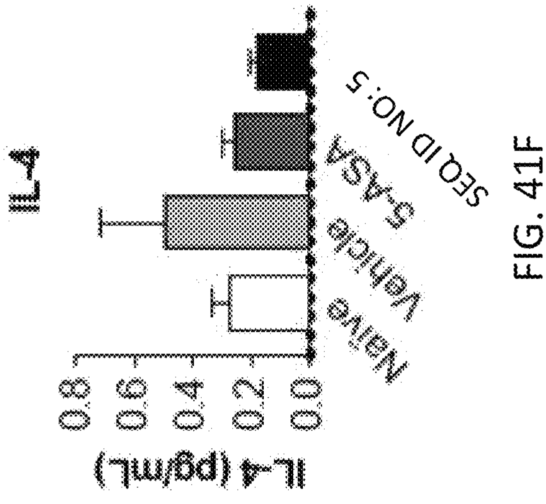
Figure 41G:
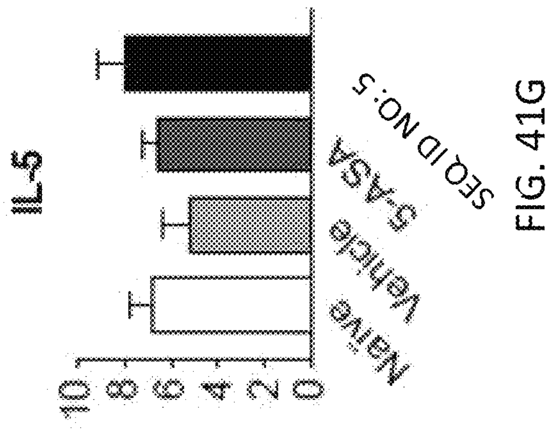
Figure 41H:
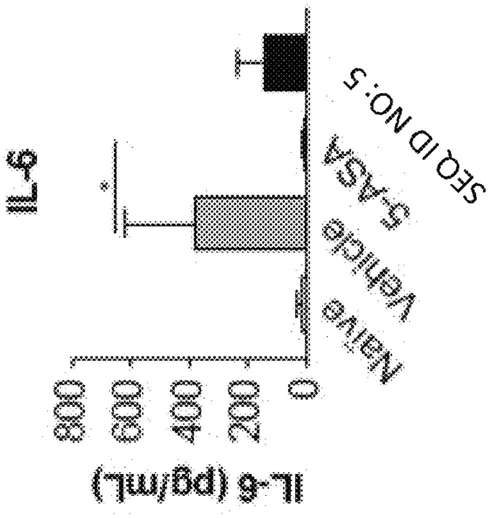
Figure 41I:
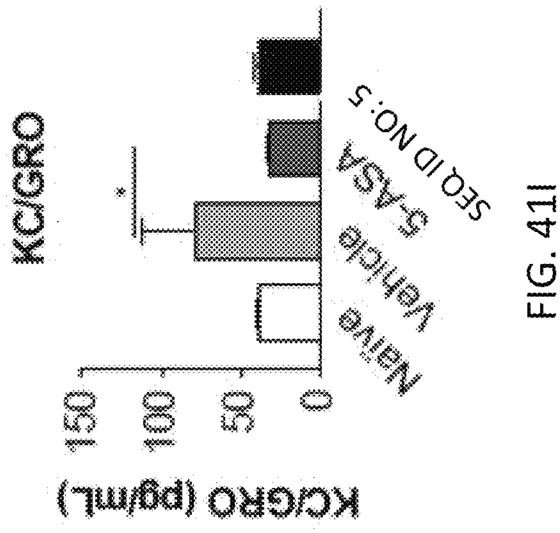
Figure 41J:
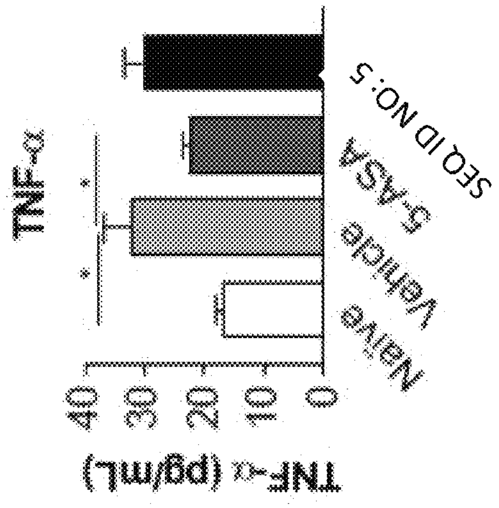

Suppression of the trend for oxazolone induction of the proinflammatory cytokines IL-6 and IL-23 was observed with 5-ASA and the IL-10 delivery construct treatment (FIGS. 40A-40B). Compared with Vehicle controls, prophylactic IL-10 delivery construct treatment resulted in plasma IL-23 and IL-6 concentrations that were reduced by 73% and 33%, respectively.

The plasma concentration of 10 cytokines and chemokines that play key effector or regulator roles in inflammation were determined using the high sensitivity of the MSD electrochemiluminescence immunoassay (FIGS. 41A-41J). Induction of colitis with oxazolone resulted in trends for increased levels of all cytokines except for IL-5, although statistical significance was not reached for any (probably on account of the high variability observed in the Vehicle control groups). Relative to the Vehicle controls, the IL-10 delivery construct significantly reduced the expression of IL-10 and IL-2 ($p<0.05$) and revealed a trend for suppressing the induction of IL-4 (62%), IL-6 (61%), IL-12p70 (65%) and the neutrophil chemoattractant KC/GRO (51%).

Discussion

This in vivo efficacy study evaluated the ability of 8.45 mg/kg IL-10 delivery construct (SEQ ID NO: 5) administered by oral gavage to prevent (prophylactic mode of treatment) the development of chemically-induced colitis caused by the hapten oxazolone. The IL-10 delivery construct treatment exhibited efficacy in this model, as evidenced by beneficial effects on colon weight and histopathological severity score, which are relevant pathological disease indices established previously with this model of induced colitis in mice. Without being bound by any particular theory, these observations are likely attributable to a direct effect of the IL-10 delivery construct on the lamina propria.

At the molecular level, oxazolone increased the number of CD4- and Foxp3-expressing T cells within the colon. However, this model of oxazolone-induced colonic inflammation did not initiate the significant cascade of chemokines and cytokines generally associated with the immune response in UC. The absence of a robust response may be due to the presence of high variability within the treatment groups.

Conclusion

In conclusion, the results collectively demonstrated that prophylactic treatment with the IL-10 delivery construct (SEQ ID NO: 5), delivered as an 8.45 mg/kg (mpk) oral dosing solution, had the capacity to suppress oxazolone-induced colitis in mice, as assessed by clinical signs of UC. While oral delivery of the IL-10 delivery construct (SEQ ID NO: 5) had no clear effect on the immunological expression profile within the colon, subchronic dosing did elicit significant and trending suppression of systemic proinflammatory cytokines that are associated with intestinal inflammation.

Example 15—Dose-Response Efficacy of an IL-10 Delivery Construct in the Murine Models of Oxazolone- and Dextran Sulfate Sodium (DSS)-Induced Ulcerative Colitis The DSS-induced experimental colitis model in mice employs the delivery of a chemical colitogen with anticoagulant properties in the drinking water. The insult results in damage to the epithelial monolayer of the large intestine and the dispersal of pro-inflammatory intestinal contents into the underlying tissue. The popularity of this model in IBD research arises from its rapidity and reproducibility, and the model can be manipulated to elicit acute, chronic and relapsing models of IBD depending on the concentration of DSS and the frequency of administration.

Example 13 demonstrated the therapeutic potential of the IL-10 delivery construct when dosed prophylactically; an oral dosing solution of 8.45 mg/kg IL-10 delivery construct showed moderate efficacy for preventing colitis development as measured by multiple disease parameters.

In this Example, both the oxazolone and DSS-induced colitis models were used to evaluate the dose-response efficacy of the IL-10 delivery construct (SEQ ID NO: 5). The anti-inflammatory agent, 5-ASA, was included within the study to serve as a positive control for suppression of oxazolone-induced inflammation. 5-ASA has been widely used in the clinic to treat mild to moderate UC due to its relative effectiveness, safety and high tolerability. The immunosuppressant cyclosporine (CsA) was utilized as a positive control in the DSS study; this treatment is frequently used in the clinic for the treatment of Crohn's disease (CD).

To evaluate target engagement of our dosing solution, the IL-1 receptor antagonist (IL-1Ra) was evaluated as a candidate pharmacodynamic biomarker of the IL-10 delivery construct. Secreted by epithelial, immune cells and adipocytes, IL-1Ra binds the IL-1 receptor but fails to induce signaling, thus antagonizes IL-1-mediated inflammation. The efficacy of IL-10 delivery construct prophylactic treatment was assessed by evaluating a number of disease parameters in vivo. In addition, the effect of the IL-10 delivery construct on circulating concentrations of cytokines and chemokines that are altered with intestinal inflammation was also assessed.

The objectives of this study were to: (1) evaluate the dose-response to the IL-10 delivery construct (0.3, 1, 3 and 9 mg/kg) in oxazolone-induced murine colitis by assessing multiple in-life disease parameters (body weight loss, stool consistency, hemoccult), survivability, post-necropsy colon morphology (weight and length) and colon histopathology; (2) evaluate the dose response to the IL-10 delivery construct (0.3, 3, 10, 30 mg/kg) in the DSS-colitis model by assessing in-life and necropsy disease parameters and histology; (3) assess the anti-inflammatory efficacy and mechanism of the IL-10 delivery construct by measuring the plasma concentrations of cytokines and chemokines using the Luminex and MSD platforms; and (4) assess potential IL-10 delivery construct-induced pharmacodynamic biomarkers by determining tissue gene expression and plasma concentrations of IL-1Ra and tissue concentration of pSTAT3.

Methods

Mice were maintained in a controlled environment with a temperature of 70-72° F., humidity 30-70%, and photo cycle of 12 hours of light and 12 hours of dark. Mice were provided with TEKLAD 2018-Global 18% diet and Arrowhead drinking water ad libitum. Mice were acclimatized for a period of seven days.

Colitis induction by oxazolone and prophylactic treatment in mice were conducted. Female SJL/J mice between 7-8 weeks of age were pre-sensitized with a 3% solution of oxazolone in 100% ethanol (Sigma Aldrich, USA; Catalog #: E0753) on a patch of dorsal skin at day −5 and intrarectally challenged with a 1% oxazolone solution in 40% ethanol on day 0. The animals were orally treated q.d. with dosing solutions of the IL-10 delivery construct (SEQ ID NO: 5) (0.3, 1, 3, and 9 mg/kg), aminosalicylate (5-ASA, 100 mg/kg; Sigma Aldrich, USA; Catalog #: A3537) or Vehicle control (10 mg/mL soybean trypsin inhibitor in 200 mM sodium bicarbonate; IL-10 delivery construct formulation buffer) from day −5 through day 6. Naïve mice were pre-sensitized and challenged with ethanol alone. Daily body weight and disease parameters (fecal consistency, hemoccult positivity) were recorded to generate a disease activity index (DAI). Plasma and colonic tissues were collected at study termination on day 7. This study was performed under non-GLP conditions and conducted according to the INVITEK protocol and INVITEK Standard Operating Procedures. Experimental design and group numbers for the oxazolone treatment are summarized in TABLE 41.

DSS-induction of murine colitis was performed by Bolder BioPATH, Inc. (CO, USA). Female C57BL6/J mice (8-10 weeks old) were given 2.5% dextran sodium sulfate (w/v) (Spectrum, Lot #2DC0020) ad libitum in the drinking water from day 0 through day 7. On day 7, DSS was replaced with water, and the animals were maintained until day 10. The mice were orally administered (q.d.) the IL-10 delivery construct (0.3, 3.0, 10 or 30 mg/kg), Vehicle control (10 mg/mL soybean trypsin inhibitor in 200 mM sodium bicarbonate; formulation buffer for the IL-10 delivery construct) or a positive control cyclosporine A (Teva, Lot #4R506001) which was prepared in Kolliphor EL (Sigma, C5135, Lot #BCBP4773V) and 1% carboxymethylcellulose (CMC: BBP, Batch #2017, Lot #3) at 75 mg/kg beginning day 0 until day 10, when they were sacrificed for plasma and tissue collection at 4 hours post-dose. Experimental design and group numbers for the DSS treatment are summarized in TABLE 42.

TABLE 41

Oxazolone group and treatment information

| Group | Description | N | Route of administration | Dose (mg/kg) | Dose volume (mL/kg) | Dosing frequency |
|---|---|---|---|---|---|---|
| A | Control, no oxazolone (Naïve) | 5 | p.o. | N/A | 10 | q.d., Day-5-+6 |
| B | Oxazolone + oral gavage Vehicle (Vehicle) | 10 | p.o. | N/A | 10 | q.d., Day-5-+6 |
| C | 5-ASA (positive control) | 15 | p.o. | 100 | 10 | q.d., Day-5-+6 |
| D | IL-10 delivery construct (9.0 mg/kg; Blue) | 15 | p.o. | N/A | 10 | q.d., Day-5-+6 |
| E | IL-10 delivery construct (3.0 mg/kg; Green) | 15 | p.o. | N/A | 10 | q.d., Day-5-+6 |
| F | IL-10 delivery construct (1.0 mg/kg; Red) | 15 | p.o. | N/A | 10 | q.d., Day-5-+6 |
| G | IL-10 delivery construct (0.3 mg/kg; Purple) | 15 | p.o. | N/A | 10 | q.d., Day-5-+6 |

TABLE 42

DSS group and treatment information

| Group | Description | N | Route of administration | Dose (mg/kg) | Dose volume (mL/kg) | Dosing frequency |
|---|---|---|---|---|---|---|
| 1 | Naïve | 5 | n/a | n/a | n/a | n/a |
| 2 | Vehicle | 10 | PO | n/a | 10 | q.d., Day 0-10 |
| 3 | CsA | 10 | PO | 75 | 10 | q.d., Day 0-10 |
| 4 | IL-10 delivery construct | 10 | PO | 0.3 | 10 | q.d., Day 0-10 |
| 5 | IL-10 delivery construct | 10 | PO | 3 | 10 | q.d., Day 0-10 |
| 6 | IL-10 delivery construct | 10 | PO | 10 | 10 | q.d., Day 0-10 |
| 7 | IL-10 delivery construct | 10 | PO | 30 | 10 | q.d., Day 0-10 |

For both the oxazolone and DSS colitis studies, hematoxylin and eosin staining of formalin-fixed and paraffin-embedded cross sections of the approximate proximal, mid, and distal colon were conducted by Bolder BioPath (Boulder, Colo.). For each region, two equidistant pieces are cut and embedded in paraffin. Each piece was evaluated individually, and values are averaged separately for the proximal, middle, distal, and total colon. Histopathology was blindly assessed by the presence of edema, inflammation, gland loss, erosion, mucosal thickness and hyperplasia to give a summed score. The presence of inflammatory cell infiltrates and lymphoid aggregate count and diameter were also determined.

The Luminex assay was performed in the Human Immune Monitoring Center at Stanford University. Mouse 38 plex kits were purchased from eBiosciences/Affymetrix and used according to the manufacturer's recommendations with modifications as described herein. Beads were added to a 96-well plate and washed in a Biotek ELx405 washer. Samples were added to the plate containing the mixed antibody-linked beads and incubated at room temperate for 1 hour followed by overnight incubation at 4° C. with shaking. Cold and room temperature incubation steps were performed on an orbital shaker at 500-600 rpm. Following the overnight incubation, plates were washed in a Biotek ELx405 washer and then biotinylated detection antibody added for 75 minutes at room temperature with shaking. Plates were washed as above and streptavidin-PE was added. After incubation for 30 minutes at room temperature, washing was performed as above and reading buffer was added to the wells. Each sample was measured in duplicate. Plates were read using a Luminex 200 instrument with a lower bound of 50 beads per sample per cytokine. Custom assay control beads by Radix Biosolutions were added to all wells.

RNA was extracted from the near-distal colon segments (between 1-2 cm from the rectum) of oxazolone-inflamed and treated mice. RNA purity was confirmed with absorbance ratios at 260/280 of 1.9-2.15 and 260/230>1.7. RNA samples were reverse transcribed to cDNA using RNeasy Mini Kit (Qiagen, #74106) and iScript™ cDNA Synthesis Kit (Bio-Rad, #1708891BUN). RT-PCR analysis of mouse IL-1Ra, IL-1β and GAPDH was performed in technical duplicates using Applied Biosystems PowerUp SYBR Green Master Mix (Thermo Fisher Scientific, #A25777). Primer sequences are listed in TABLE 43. Transcript expression was normalized to that of an internal control, GAPDH, and fold-changes were calculated using the AA-CT method.

TABLE 43

| RT-PCR primer sequences | | |
|---|---|---|
| Primer Name | Sequence | SEQ ID NO: |
| ms IL-1Ra-F | GCTCATTGCTGGGTACTTACAA | SEQ ID NO: 14 |
| ms IL-1Ra-R | CCAGACTTGGCACAAGACAGG | SEQ ID NO: 15 |
| ms IL-1β-F | CACAGCAGCACATCAACAAG | SEQ ID NO: 16 |
| ms IL-1β-R | GTGCTCATGTCCTCATCCTG | SEQ ID NO: 17 |
| ms GAPDH-F | TGTGTCCGTCGTGGATCTGA | SEQ ID NO: 18 |
| ms GAPDH-R | CCTGCTTCACCACCTTCTTGA | SEQ ID NO: 19 |

Plasma cytokines were quantified using the V-plex Proinflammatory Panel 1 Mouse Kit. Plasma IL-1Ra was quantitated by sandwich immunoassay using an antibody pair from the Mouse IL-1Ra/IL-1F3 DuoSet ELISA (R&D Systems #DY480), Streptavidin SULFO-TAG Labeled (MSD #R32AD-1), Multi-Array 96 Plate Pack, SECTOR Plate MSD #L15XA-3 and Read Buffer T (4×) (MSD #R92TC-2). Samples were read on the QuickPlex SQ 120 plate reader (Meso Scale Discovery, Rockville, Md.).

The Human IL-10 Base kit (MSD #K151AOA-4) was used to measure rhIL-10 in plasma. The anti-human IL-10 capture and detection antibody pair in this immunoassay did not react with mouse IL-10, but did react with human IL-10. The MSD Small Spot IL-10 plate was incubated with Diluent 41 (25 μL/well) for 30 minutes at room temperature with shaking before use. Controls and samples were diluted 2-fold with pooled CD-1 mouse plasma (BioIVT, custom order), and the calibration standards were also prepared in mouse plasma. Standards, diluted samples and controls were added (25 μL/well), and the plate was incubated for 2 hours at room temperature with shaking. The plate was washed 3 times with phosphate buffered saline with Tween-20 (PBST), and 25 μL/well 1×SULFO TAG Anti-human IL-10 Antibody (prepared in Diluent 45) was added to the plate. The plate was incubated for 1 hour at room temperature with shaking. Following a wash step, 150 μL/well of 2×MSD Read buffer was added, and the plate was read in the MSD Sector Imager 600 plate reader.

Statistical analyses were performed using Prism 5.0 (Invitek data) or Prism 7.0 (GraphPad Software, Inc.). For the oxazolone study, data were analyzed using one-way ANOVA or two-way ANOVA followed by Bonferroni, Dunnett, or Tukey post-hoc tests. DSS-data were analyzed using one-way ANOVA followed by Dunnett's post-hoc test for parametric data or the Kruskal-Wallis test with Dunn's post-hoc test for non-parametric data. P values of <0.05 were considered significant.

Results: Oxazolone-Induced Colitis

Figure 42:
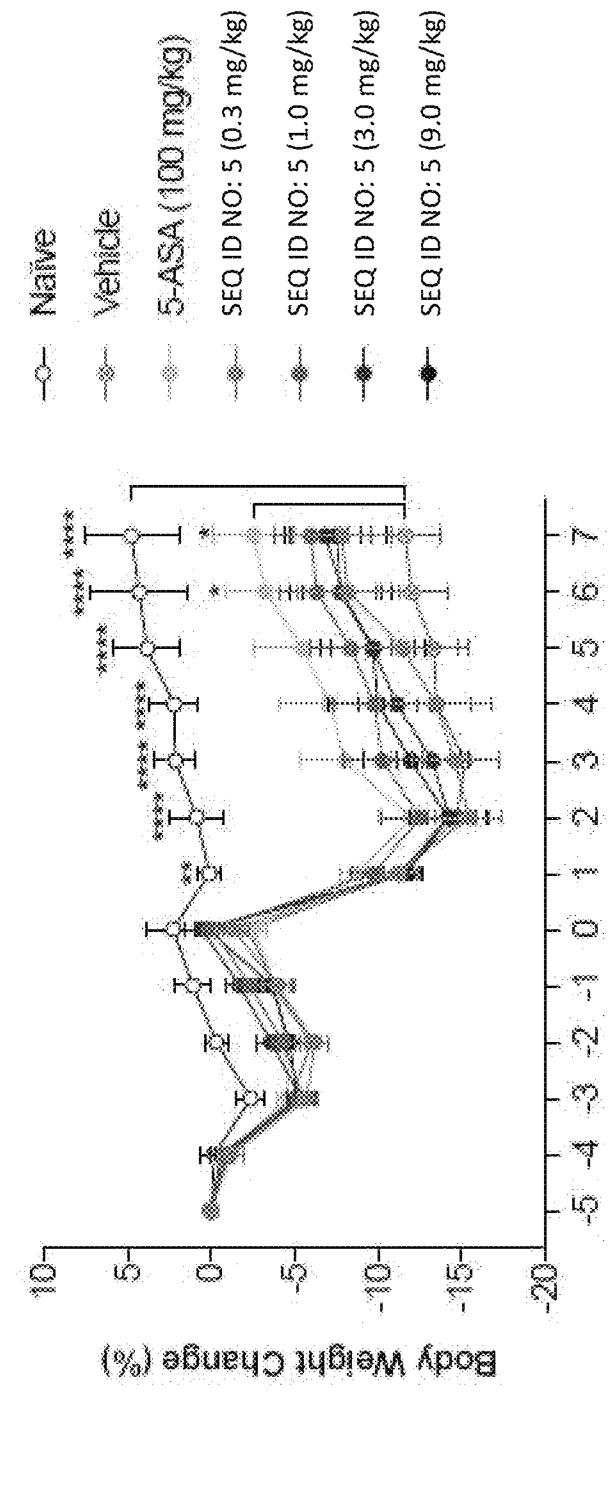
FIG. 42 illustrates the effect of the IL-10 delivery construct of SEQ ID NO. 5 on percentage change in body weight in mice following oxazolone-induced inflammatory colitis.
Figure 43:
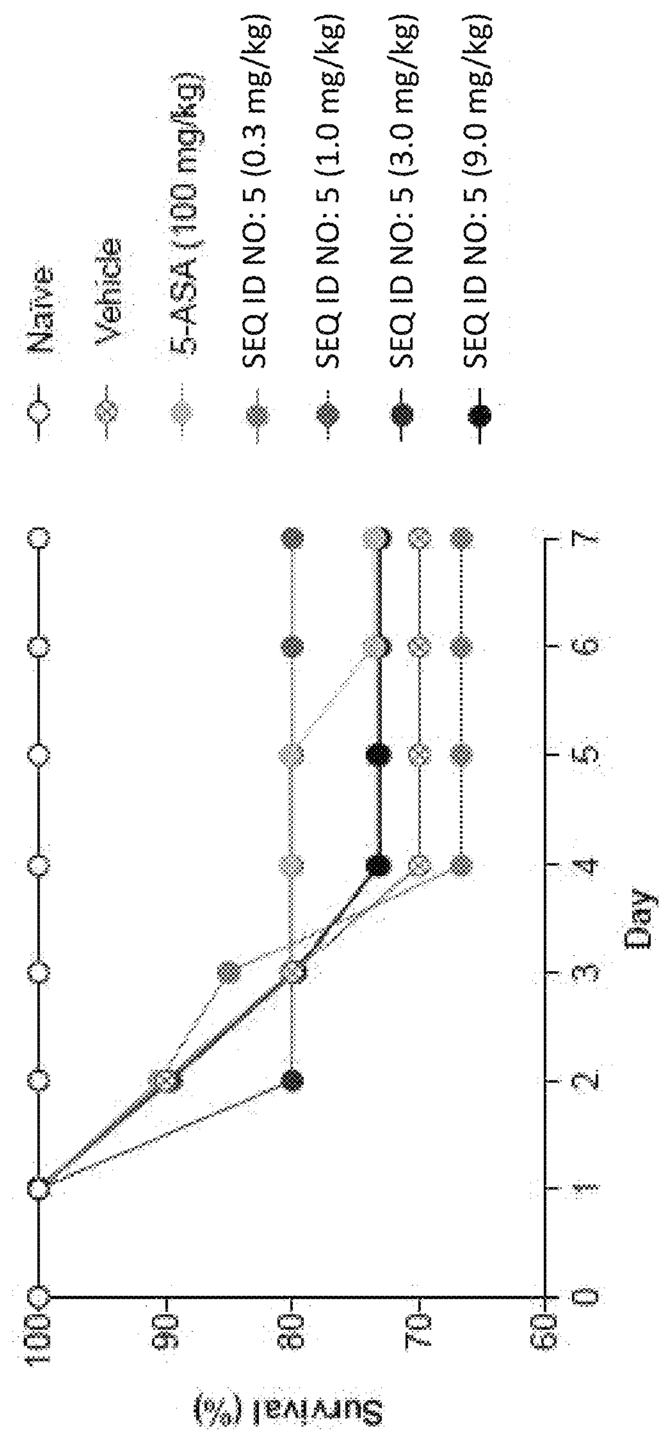
FIG. 43 illustrates the effect of the IL-10 delivery construct of SEQ ID NO. 5 on percentage survival in mice following oxazolone-induced inflammatory colitis. Mortality was recorded daily in mice preceding and following the oxazolone insult. Data are expressed as percentage survival.
Figure 44:
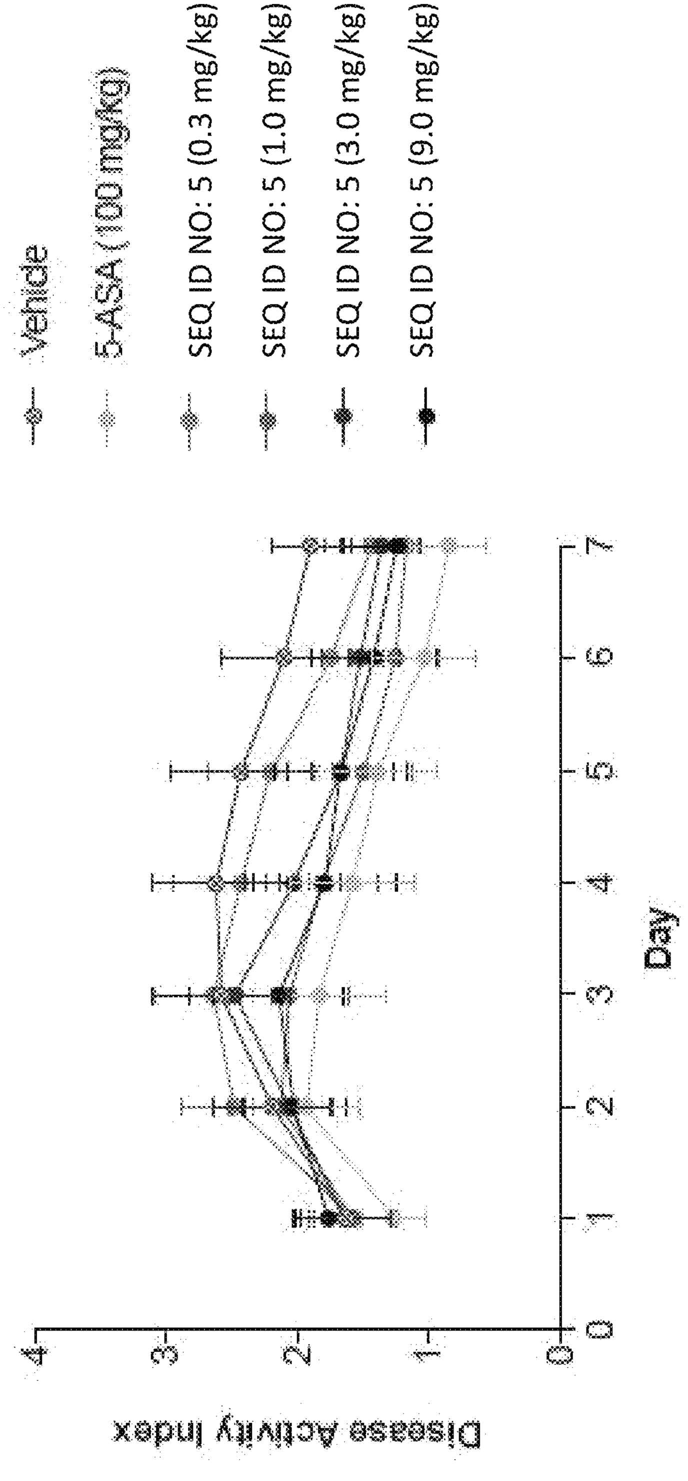
FIG. 44 illustrates the effect of the IL-10 delivery construct of SEQ ID NO. 5 on disease severity in mice following oxazolone-induced colonic inflammation. Disease activity index (DAI) was scored by fecal consistency and hemoccult positivity following the oxazolone insult. Data are expressed as mean SEM.

Oxazolone-induced colonic inflammation led to pronounced body weight loss (up to 15%) and reduced survivability (FIG. 42 and FIG. 43). The anti-inflammatory agent, 5-ASA, significantly attenuated the oxazolone-induced decrease in body weight from 6 days after the insult ($p<0.05$). The IL-10 delivery construct at the highest concentrations (1, 3 and 9 mg/kg) produced ameliorating trends in body weight loss. No significant effects on DAI, reflecting fecal consistency and hemoccult positivity, were detected between the treatment groups (FIG. 44).

Figure 45:
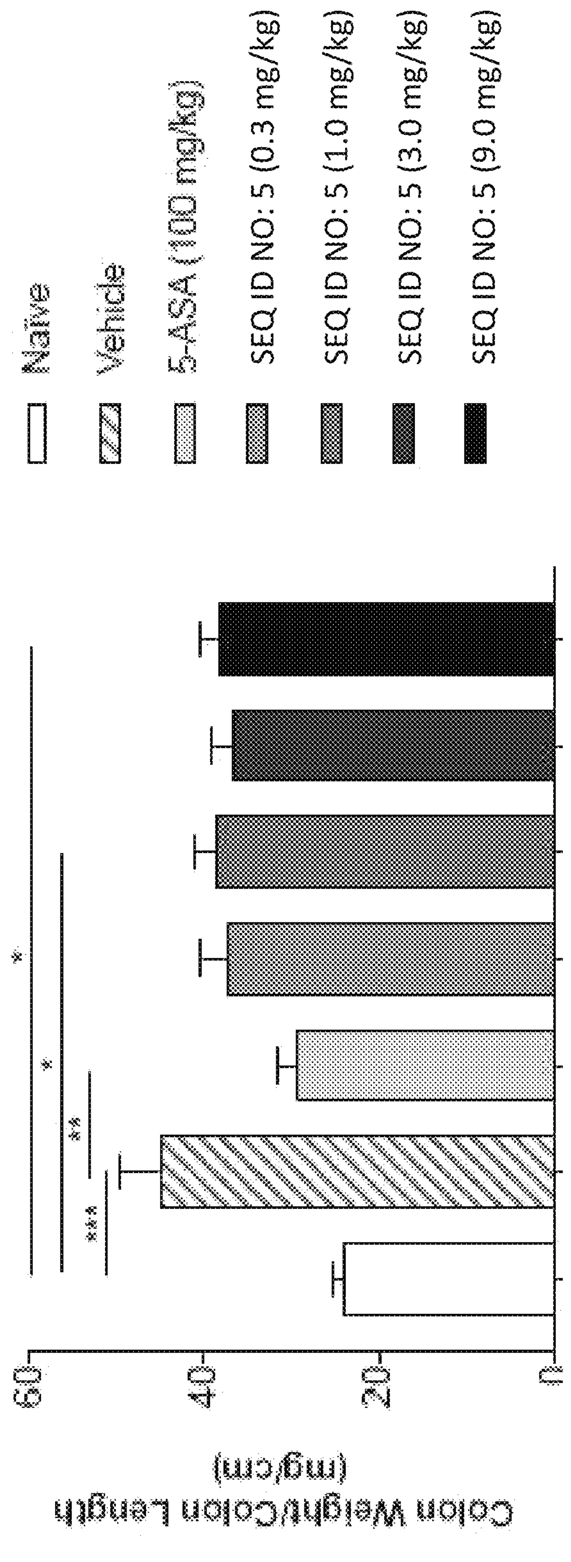
FIG. 45 illustrates the effect of the IL-10 delivery construct of SEQ ID NO. 5 on colon weight/length ratio in mice following oxazolone-induced colonic inflammation. Colon weight and length were measured 7 days after the oxazolone insult. Data are expressed as mean±SEM.

In addition, oxazolone induced a reduction in colon length and an increase in colon weight, as reflected by an increase in the colon weight/length ratio (FIG. 45). This increase was ameliorated by treatment with 5-ASA; however, IL-10 delivery construct had no statistically significant effect on colon weight or length at any of the doses tested.

Figure 46:
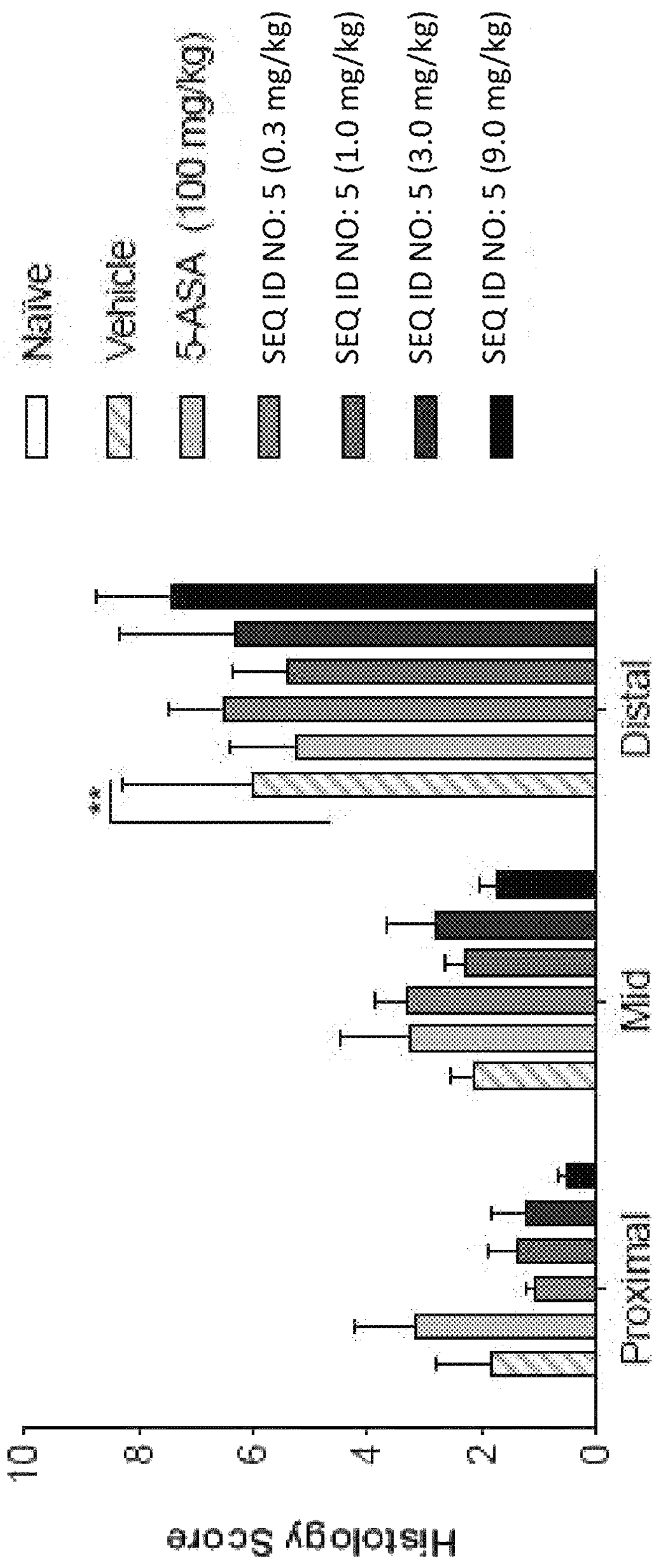
FIG. 46 illustrates the histopathology of the proximal, mid, and distal colon following oxazolone-induced colonic inflammation in mice. Data are expressed as mean SEM.

Seven inflammatory parameters (inflammation of mucosa/submucosa, erosion, gland loss, hyperplasia, edema, transmural inflammation, inflammation of serosa) were scored on a scale of 1-4 (1=minimal, 2=mild, 3=moderate, 4=marked) to assess the histopathology of the proximal, mid, and distal colon. Based on the summed score (histology score) of these seven parameters, histopathology was found to be most pronounced in the distal colon and least in the proximal colon for all treatment groups (FIG. 46). The IL-10 delivery construct, at all doses tested, did not induce any changes in histology score in the proximal, mid or distal colon, when compared to the Vehicle control.

Figures 47A, 47B, 47C, 47D, 47E, 47F, 47G, 47H, 47I, 47J, 47K, 47L, 47M, 47N, 47O:
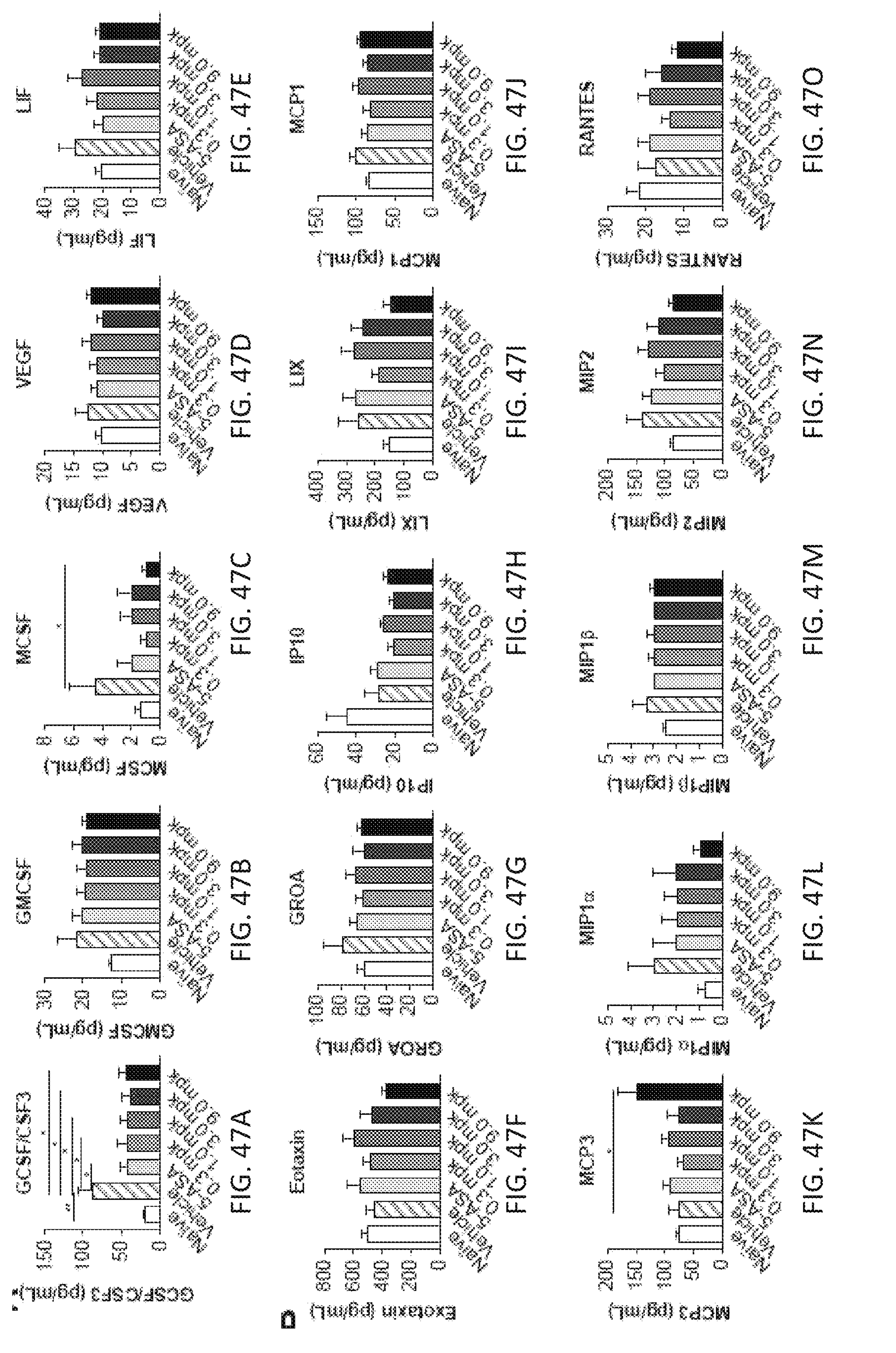
FIGS. 47A-47LL illustrate systemic concentrations of circulating cytokines, chemokines, and growth factors in mice. Plasma concentrations of circulating cytokines were analyzed using the Luminex bead array. Data are expressed as mean SEM.
FIG. 47M illustrates systemic concentration of MIP1β.
FIG. 47N illustrates systemic concentration of MIP2.
FIG. 47O illustrates systemic concentration of RANTES.
Figure 47P:
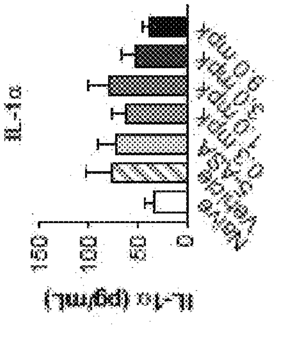
FIG. 47P illustrates systemic concentration of IL-1α.
Figure 47Q:
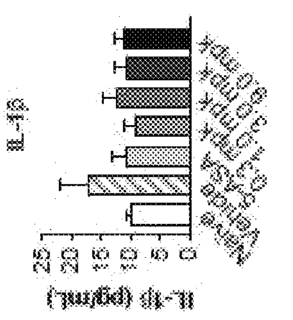
FIG. 47Q illustrates systemic concentration of IL-1β.
Figure 47R:
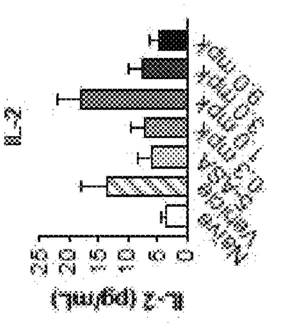
FIG. 47R illustrates systemic concentration of IL-2.

In addition to gross disease parameters, IL-10 delivery construct efficacy was also evaluated by assessing the circulating concentrations of 38 growth factors, chemokines and cytokines (FIGS. 47A-47LL). Oxazolone treatment induced an increase in the plasma concentration of granulocyte colony-stimulating factor (GCSF, also known as colony-stimulating factor 3, or CSF3; FIG. 47A) and a trend towards an increase in the macrophage chemoattractant MIP1α (FIG. 47L) and the growth factors granulocyte-macrophage colony-stimulating factor (GMCSF; FIG. 47B) and macrophage colony stimulating-factor (MCSF;

FIG. 47C), which respectively mobilize the release and differentiation of neutrophils and macrophages. Prophylactic pre-treatment with the positive control, 5-ASA, or the IL-10 delivery construct attenuated the oxazolone-induced increase in GCSF/CSF3. MSCF was also reduced at the highest dose of the IL-10 delivery construct. A trend towards a reduction was also observed for MIP1α (FIG. 47L). Changes in LPS-inducible CXC chemokine (LIX, FIG. 47I), leukemia inhibitory factor (LIF, FIG. 47E), and IP10 (CXCL10, FIG. 47H) levels induced by Oxa were mitigated by treatment with the IL-10 delivery construct.

Figure 47S:
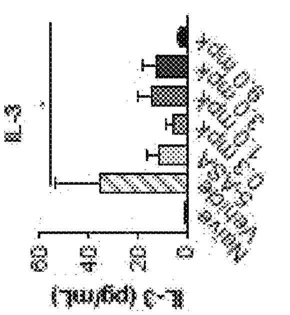
FIG. 47S illustrates systemic concentration of IL-3.
Figure 47T:
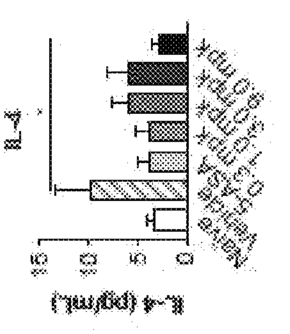
FIG. 47T illustrates systemic concentration of IL-4.
Figure 47U:
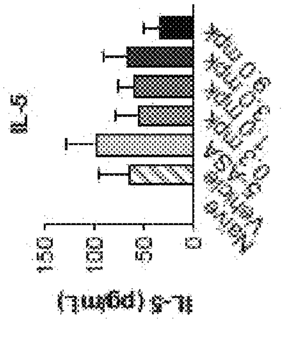
FIG. 47U illustrates systemic concentration of IL-5.
Figure 47V:
FIG. 47V illustrates systemic concentration of IL-6.
Figure 47W:
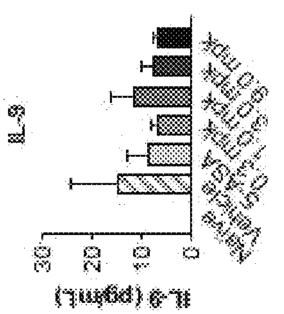
FIG. 47W illustrates systemic concentration of IL-9.
Figure 47X:
FIG. 47X illustrates systemic concentration of IL-12p70.
Figure 47Y:
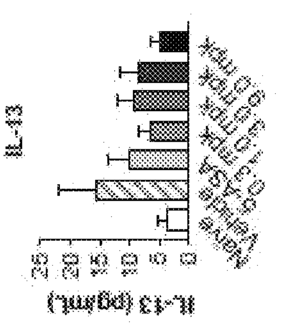
FIG. 47Y illustrates systemic concentration of IL-13.
Figure 47Z:
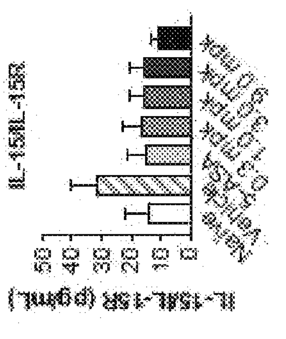
FIG. 47Z illustrates systemic concentration of IL-15/IL-15R.
Figure 47A:
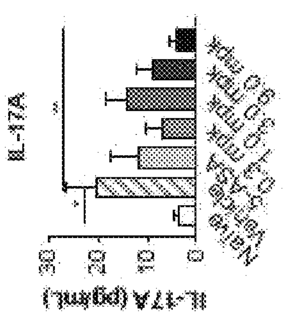
Figure 47B:
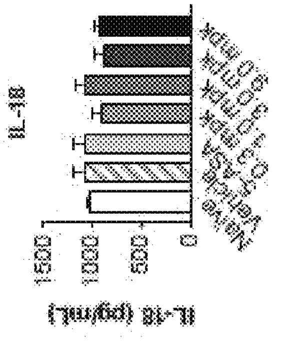
Figure 47C:
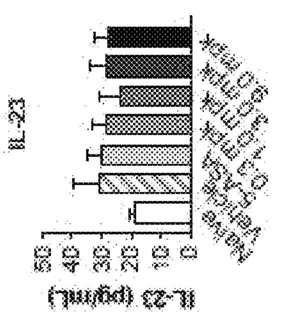
Figure 47D:
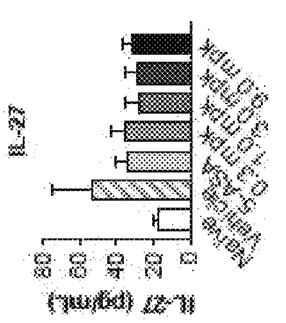
Figure 47E:
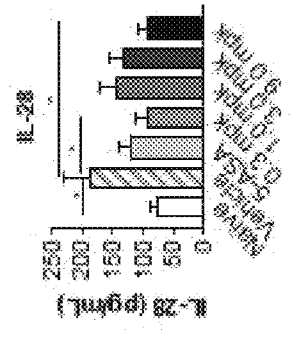
Figure 47F:
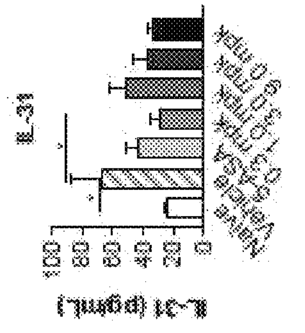
Figure 47G:
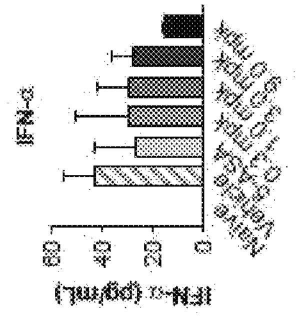
Figure 47H:
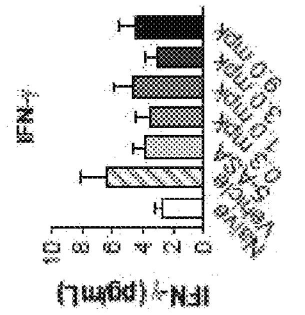
Figure 47I:
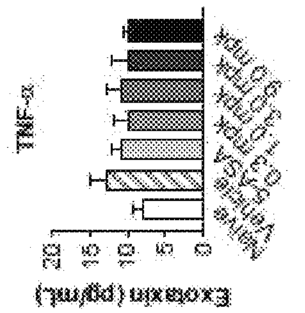
Figure 47J:
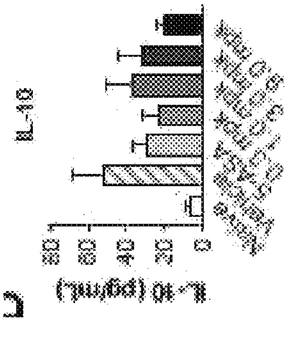
Figure 47K:
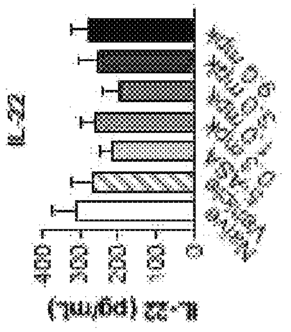
Figure 47L:
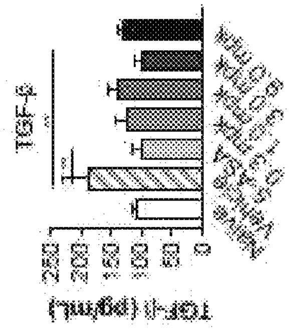
Figure 48A:
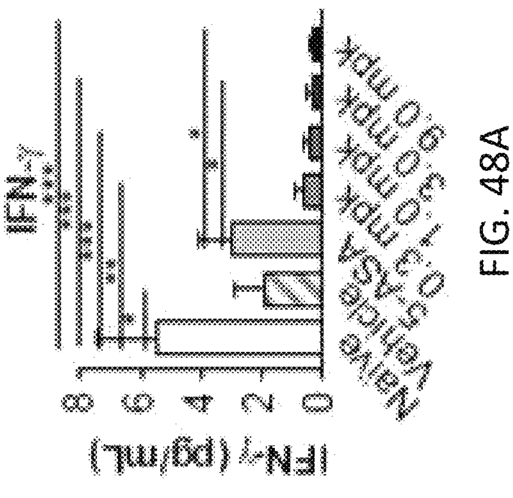
FIGS. 48A-48J illustrate concentrations of 10 cytokines in plasma samples using V-PLEX proinflammatory panel.
Figure 48B:
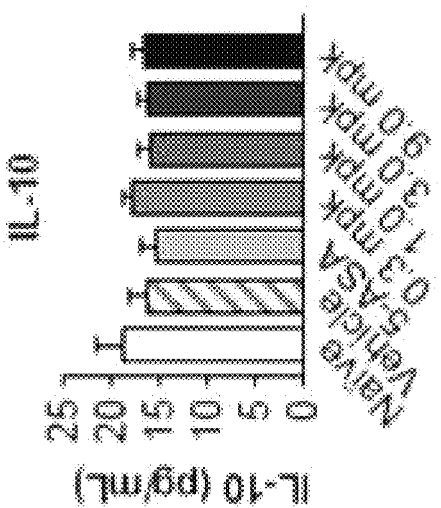
Figure 48C:
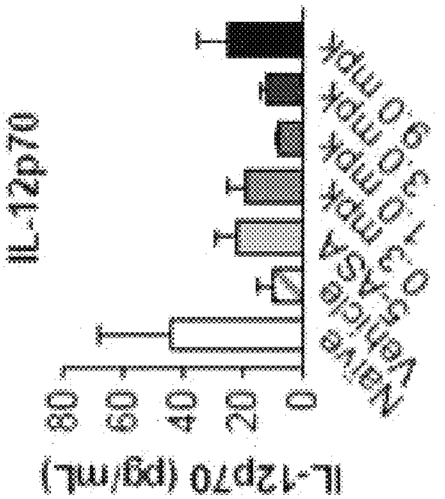
Figure 48D:
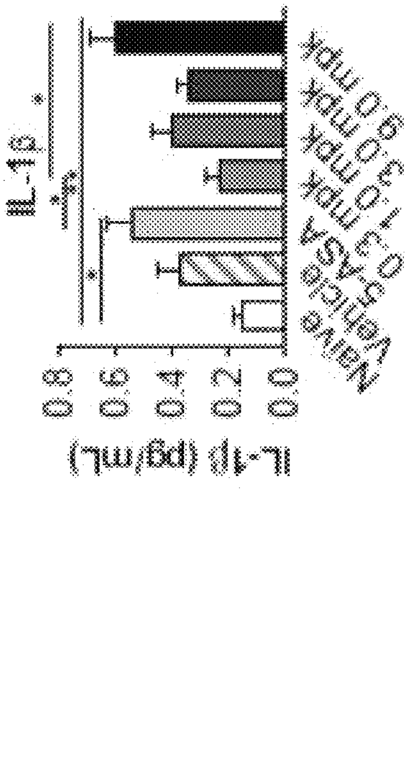
Figure 48E:
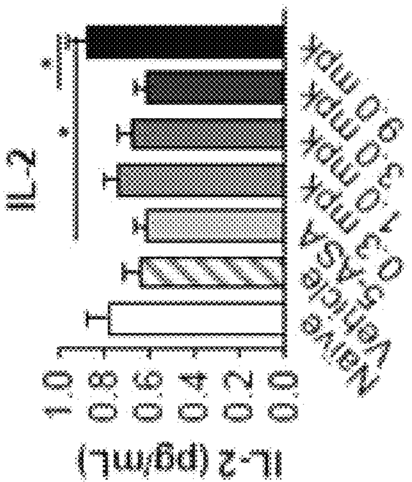
Figure 48F:
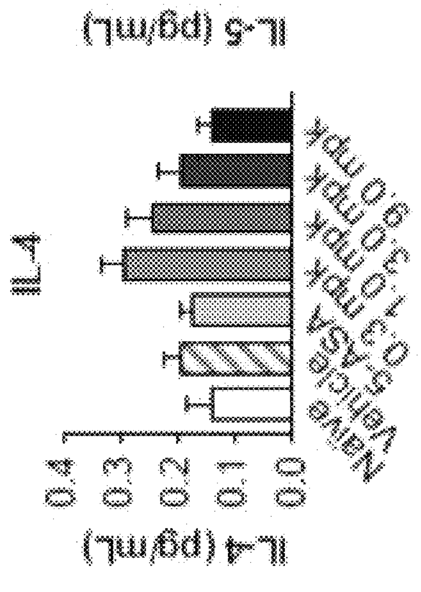
Figure 48G:
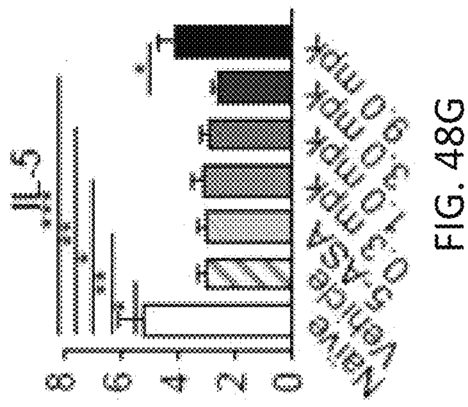
Figure 48H:
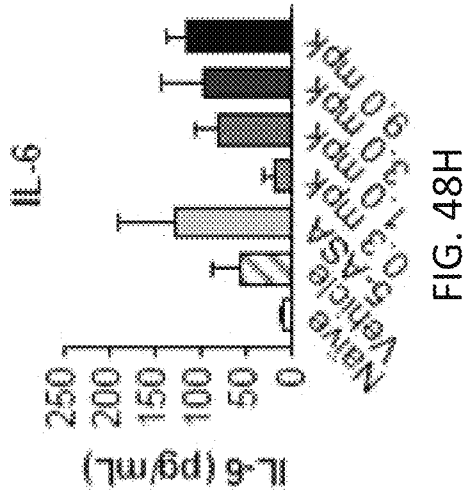
Figure 48I:
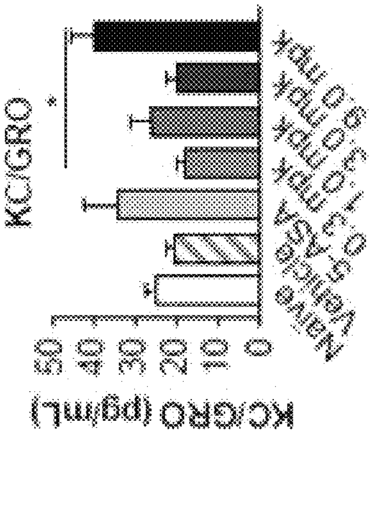
Figure 48J:
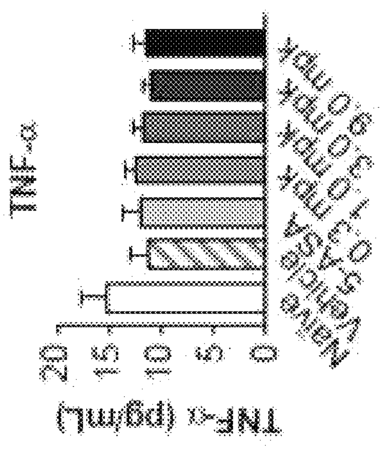

In addition to affecting innate immune cells, cytokines also control effector T cell functions. Consistent with an anti-inflammatory effect, IL-10 delivery construct pre-treatment (9.0 mg/kg dose) prevented the production of IL-12 and IL-17, key effectors of Th1 and Th17 cells, respectively. Treatment with the IL-10 delivery construct led to a reduction in the concentrations of IL-3 (9.0 mg/kg dose; FIG. 47S), IL-4 (9.0 mg/kg; FIG. 47T), IL-28 (3.0 and 9.0 mg/kg; FIG. 47EE), and IL-31 (0.3 mg/kg; FIG. 47FF) to near-base line levels. Plasma concentrations of IL-13 (FIG. 47Y) and IL-15 (FIG. 47Z) revealed a trend towards an IL-10 delivery construct-mediated decrease, compared with the Vehicle control. Beyond the pro-inflammatory cytokines, oxazolone (Vehicle treatment alone) indicated a trend towards increased secretion of endogenous IL-10 (FIG. 47JJ) and the immune-suppressive cytokine TGF-β (FIG. 47LL). This apparent counter-response to inflammation is consistent with the observed increase of TGF-β in UC colon tissue. IL-10 delivery construct treatment (3.0 mg/kg) reduced TGF-β relative to Vehicle and ameliorated this trend towards increased secretion of endogenous IL-10. For many of the cytokines analyzed, plasma concentration was not significantly induced following oxazolone treatment. Moreover, when an oxazolone-induced increase was observed, 5-ASA did not effectively return the expression of the cytokine to baseline (Naive) levels in many of the parameters tested.

Systemic cytokine concentrations in mice exposed to oxazolone-induced colitis and prophylactic treatment with the IL-10 delivery construct were additionally assessed using the MSD 10-plex proinflammatory panel. Plasma IFN-γ and IL-5 were reduced in Vehicle-treated mice with oxazolone-induced colitis vs Naïve controls, but there were no significant differences between these groups with respect to the other cytokines measured (FIGS. 48A-48J). Trend for increases in the expression of IL-1β and IL-6 were observed in response to the oxazolone insult. However, this response was not attenuated by the delivery of the positive control, 5-ASA, or the IL-10 delivery construct. Due to the absence of a substantial oxazolone-induced inflammatory response, the effect of the IL-10 delivery construct treatment was not easily decipherable; however, no significant differences between Vehicle treatment and IL-10 delivery construct were detected for any of the cytokines analyzed.

Figure 49A:
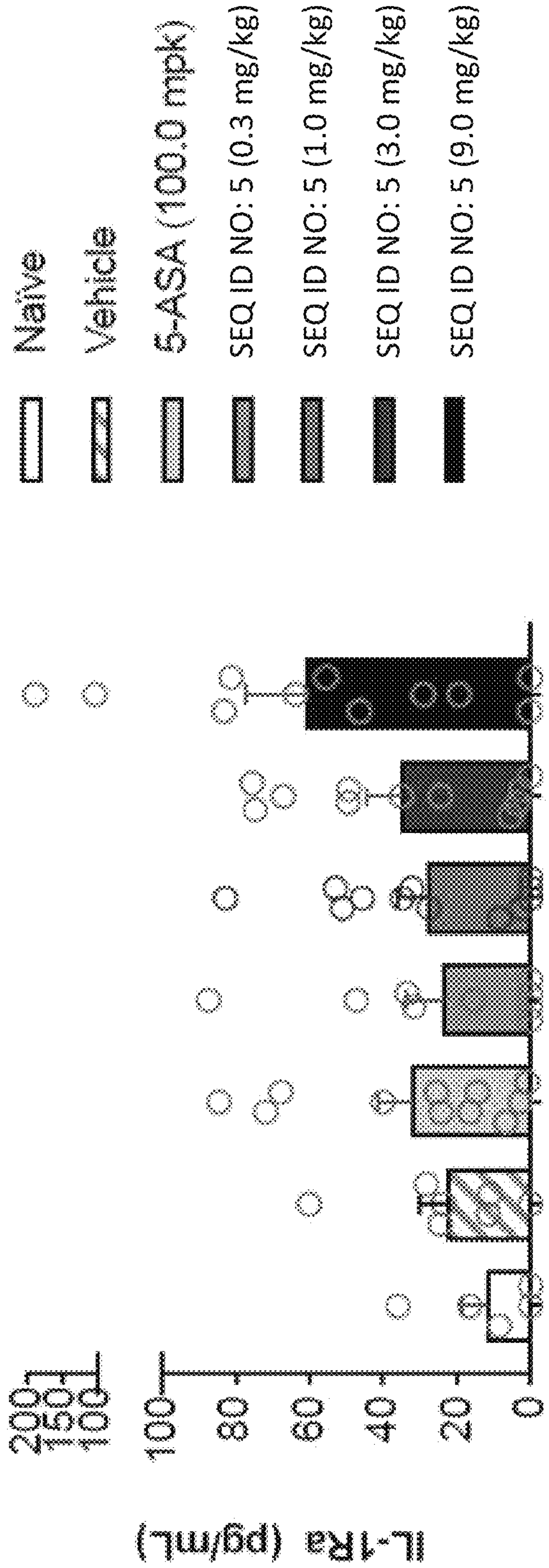
FIGS. 49A-49D illustrate systemic and colonic IL-1Ra expression in mice following oxazolone-induced inflammatory colitis.
Figure 49B:
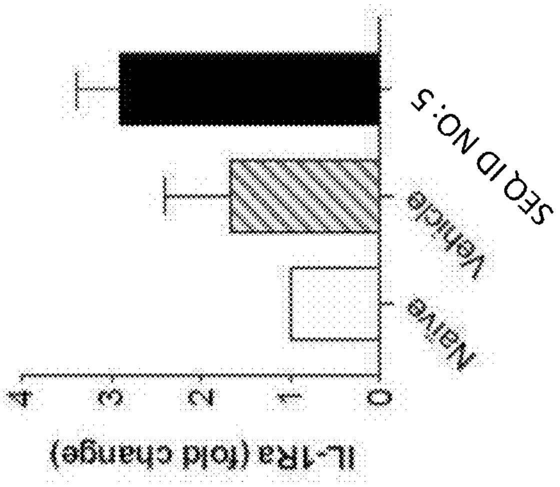
Figure 49C:
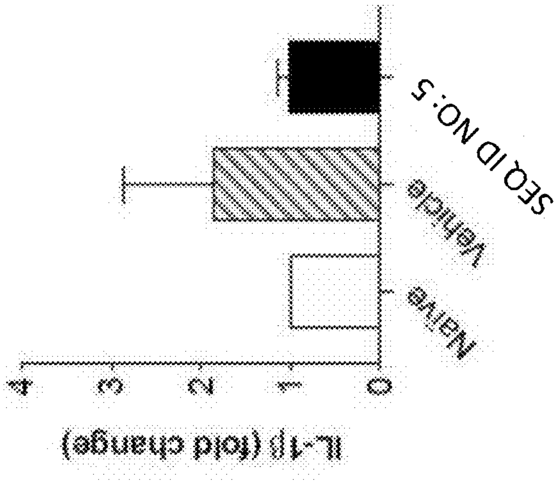
Figure 49D:
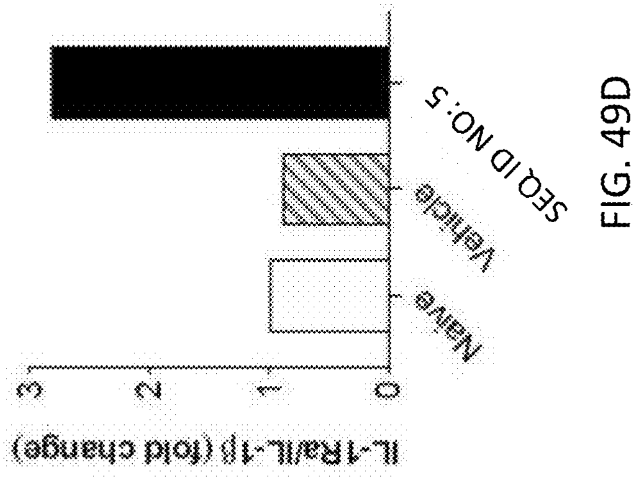

IL-10 delivery construct efficacy in the systemic circulation and colonic tissue was assessed by analyzing the expression of IL-1Ra, an IL-1β antagonist that is potentiated by IL-10. Circulating levels of IL-1Ra were not significantly altered following oxazolone insult or treatment with 5-ASA or the IL-10 delivery construct (FIG. 49A), likely due to data variability and low statistical power. However, the IL-10 delivery construct treatment did induce a dose-dependent trend towards increased IL-1Ra. In near-distal colonic tissue, the IL-10 delivery construct treatment at the highest dose of 9 mg/kg revealed a trend towards augmented mRNA expression of IL-1Ra (FIG. 49B). This result was also reflected by an increase in the IL-1Ra/IL-10 ratio (FIG. 49D).

Results: Dextran Sulfate Sodium (DSS)-Induced Colitis

Figure 50A:
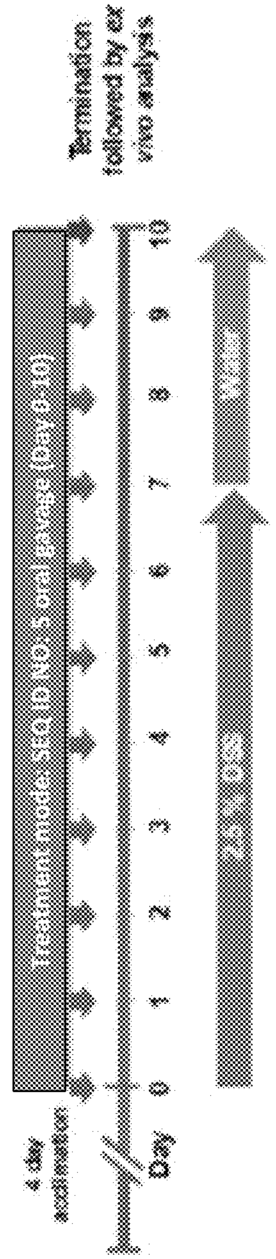
FIG. 50A illustrates the timeline of dextran sulfate sodium (DSS)-induction of colitis and treatment with daily oral gavage of the IL-10 delivery construct of SEQ ID NO. 5 (as designated) dissolved in 100 mL of PBS on days designated by a downward arrow.
Figure 50B:
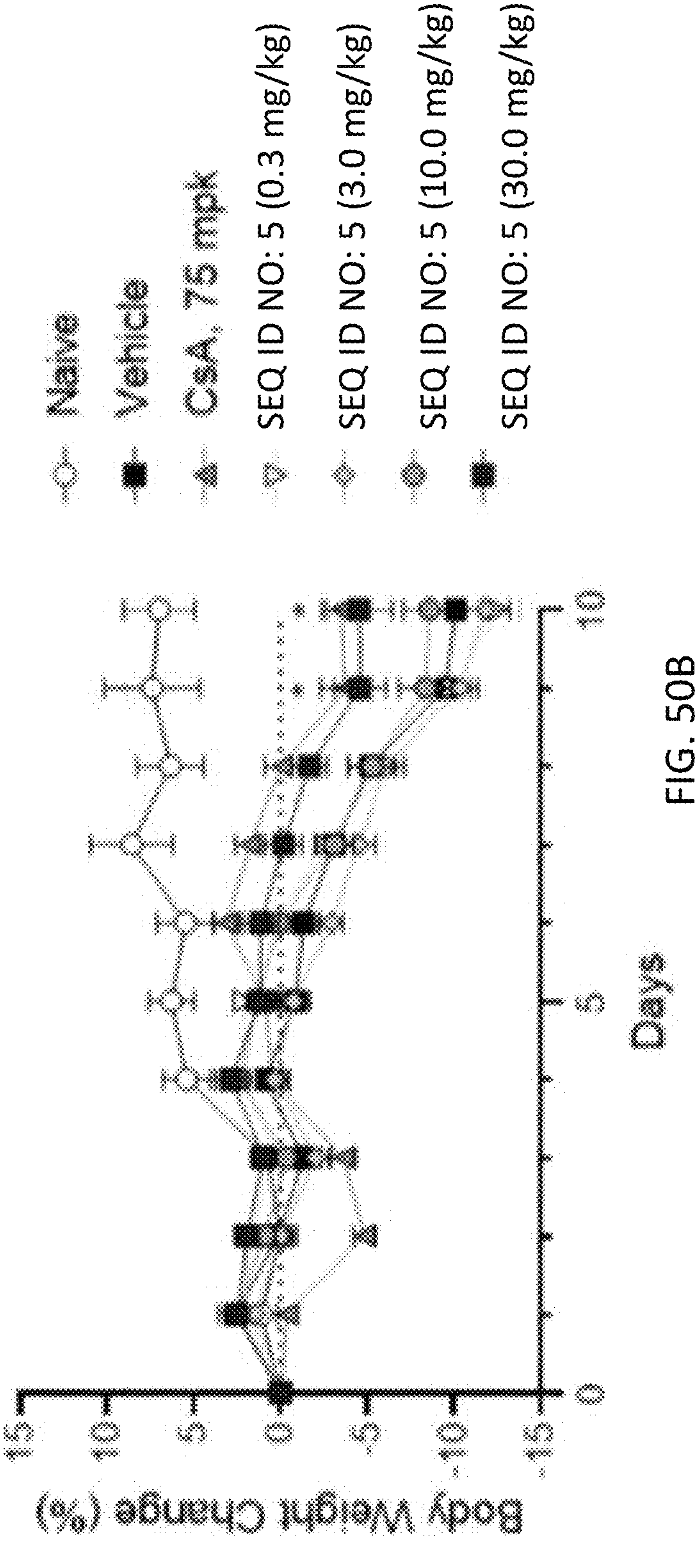
FIG. 50B illustrates DSS-induced weight loss during the in-life portion of the study.
Figure 50C:
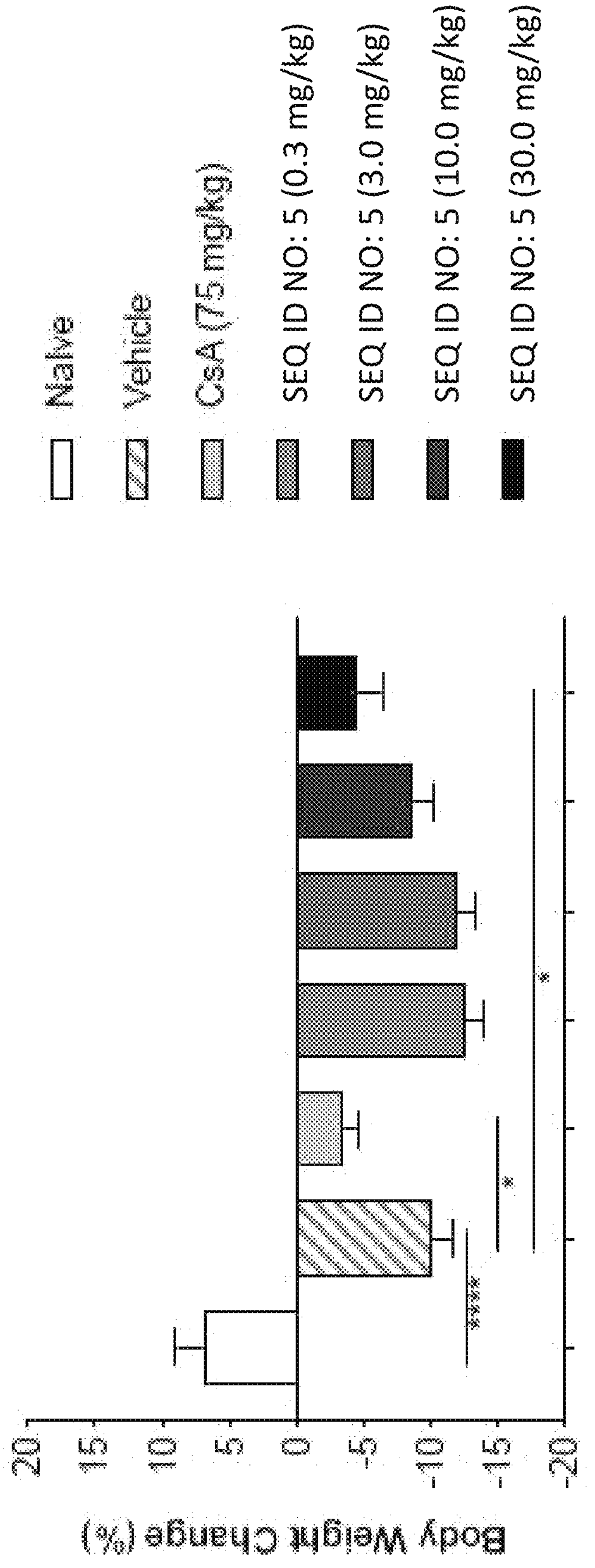
FIG. 50C illustrates the effect of the IL-10 delivery construct of SEQ ID NO. 5 on body weight following DSS-induced colitis. Body weight presented as percentage change from baseline following DSS-induced inflammation. Data are expressed as mean SEM.
Figure 51:
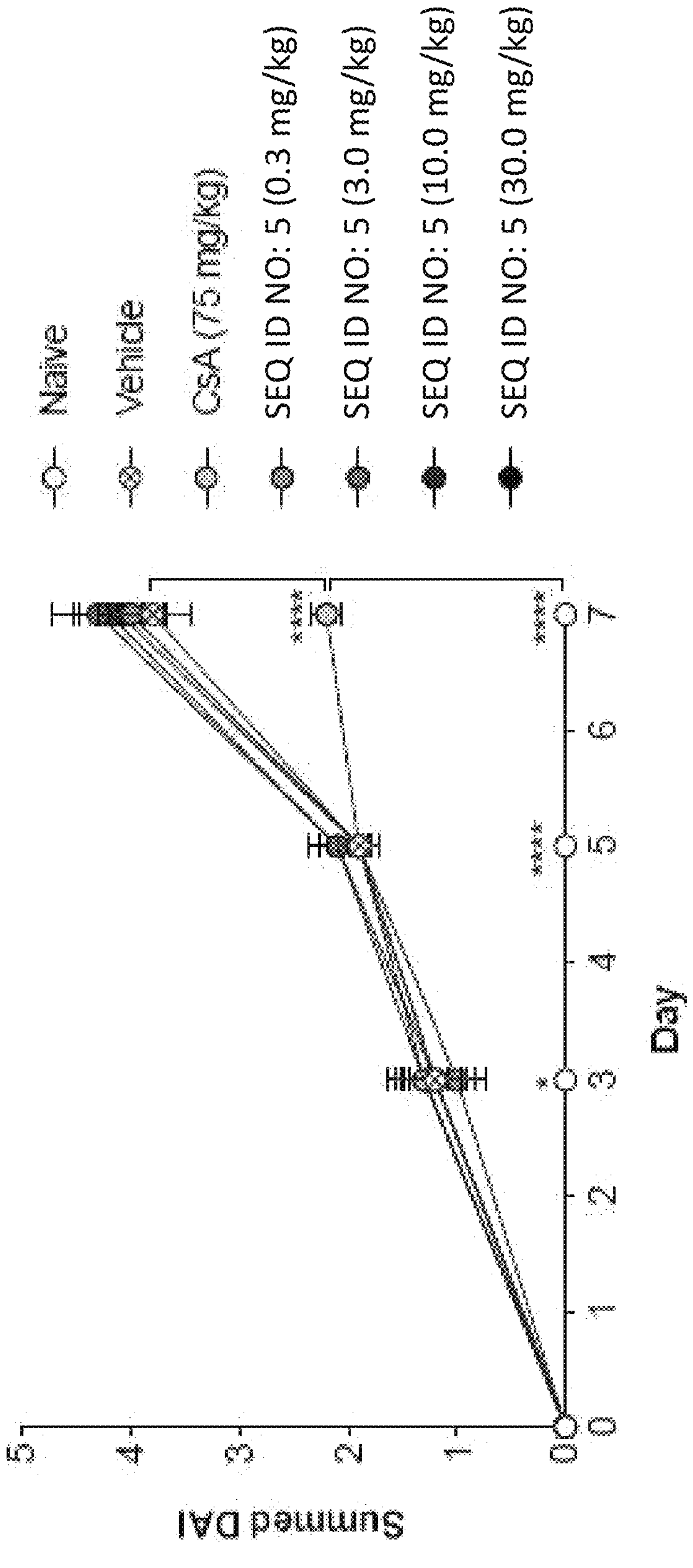
FIG. 51 illustrates the effect of the IL-10 delivery construct of SEQ ID NO. 5 on disease activity index (DAI) following DSS-induced colitis. Individual scores for weight loss, stool consistency, and stool hemoccult (scored 0-3) were summed to provide a DAI (0-9 range) in response to DSS-induced inflammation. Data are expressed as mean SEM.
Figure 52A:
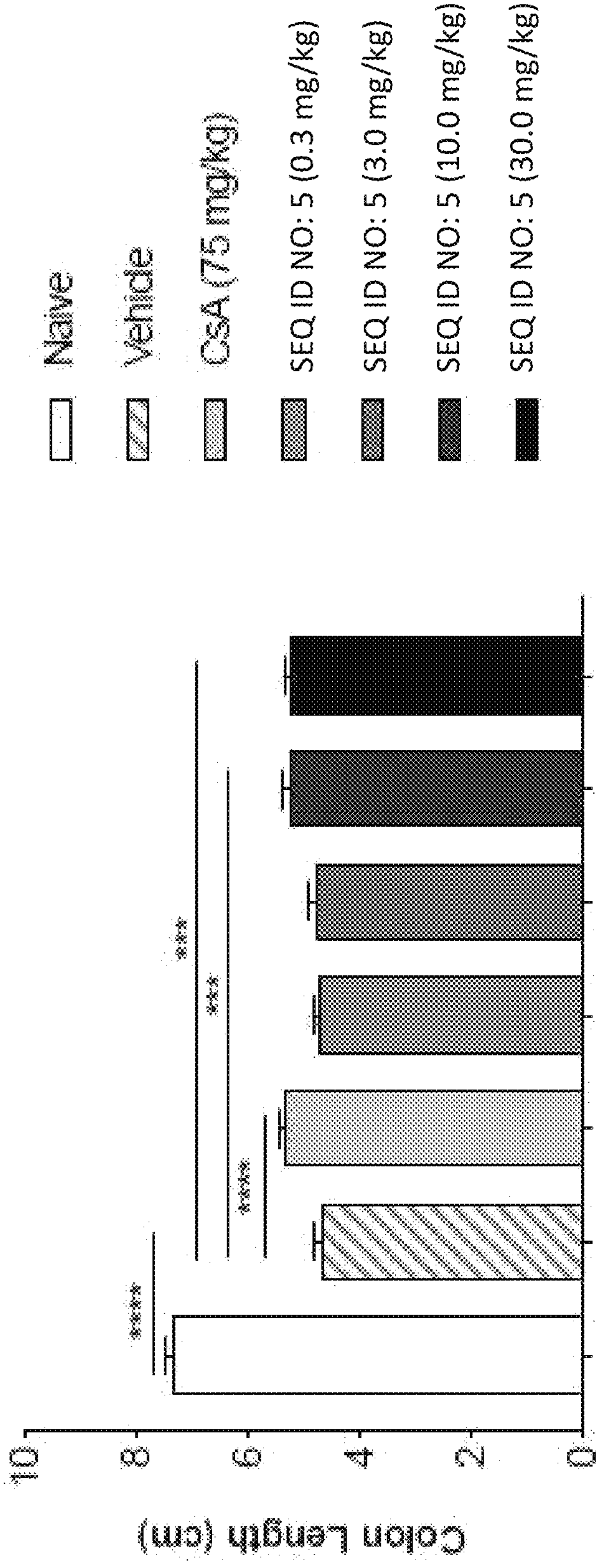
FIGS. 52A-B illustrate the effect of the IL-10 delivery construct of SEQ ID NO. 5 on colon length (FIG. 52A) and weight (FIG. 52B) following DSS-induced colitis. Data are expressed as mean SEM.
Figure 52B:
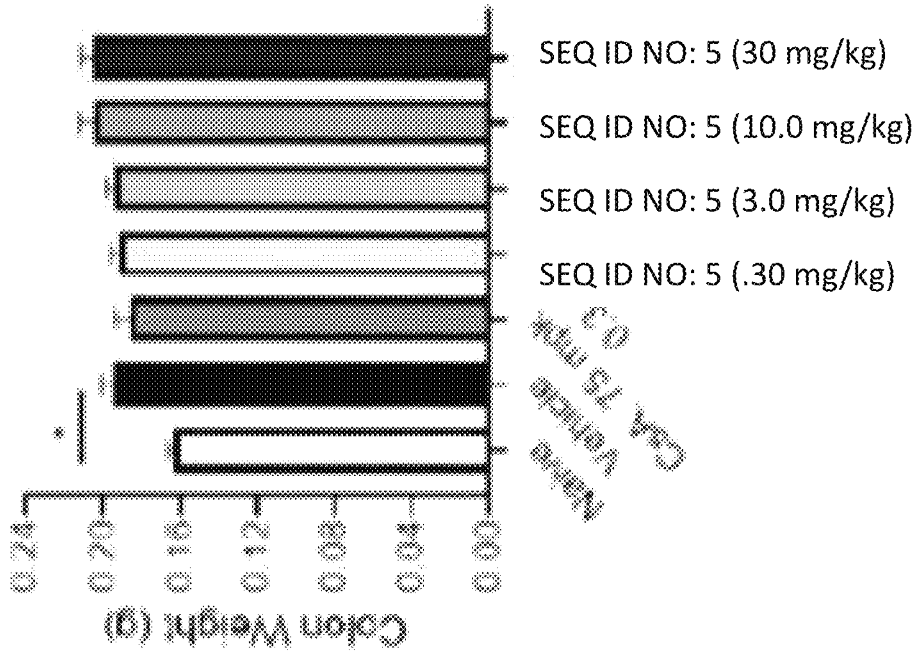

This example examines the IL-10 delivery construct's ability to suppress the mild to moderate multifocal colitis induced by dextran sulfate sodium (DSS), characterized by inflammation, edema, and mucosal necrosis when this medium-chain-length fatty acid binding agent is presented in drinking water. Mice were dosed orally once daily for 10 days with vehicle (as a negative control) or the IL-10 delivery construct of SEQ ID NO: 5 (0.3-30 mg/kg) from the induction of DSS-induced colitis (FIG. 50A). Mice dosed daily with 75 mg/kg cyclosporine A (CsA) were used as a positive control for the model and not a therapeutic comparator. The delivery construct of SEQ ID NO: 5 significantly reduced DSS-induced weight loss during the in-life portion of the study (FIG. 50B). DSS insult led to ~10% weight loss in the Vehicle group (or ~17% differential with the Naïve group, which gained weight), (FIG. 50C). Treatment with CsA partially attenuated the DSS-induced loss in body weight ($p<0.05$), as was observed with the IL-10 delivery construct, at the highest dose tested (30 mg/kg). There was no mortality in any of the treatment groups. Individual scores for weight loss, stool consistency and stool hemoccult (scored 0-3) were also summed to provide a DAI (0-9 range). Relative to the summed score of 3.8 for the Vehicle group on day 7 (and 0 for the Naïve group), scores for IL-10 delivery construct-treated groups ranged from 4.0 to 4.3 without dose-correlation, and thus do not support disease activity index (DAI) improvement by the IL-10 delivery construct (scores were not available for day 10), (FIG. 51). Significant improvement in colon length at the two top doses of the IL-10 delivery construct (10 and 30 mg/kg; $p<0.05$ compared to vehicle) indicate the presence of IL-10 delivery construct-dependent therapeutic effects (FIG. 52).

Figure 53:
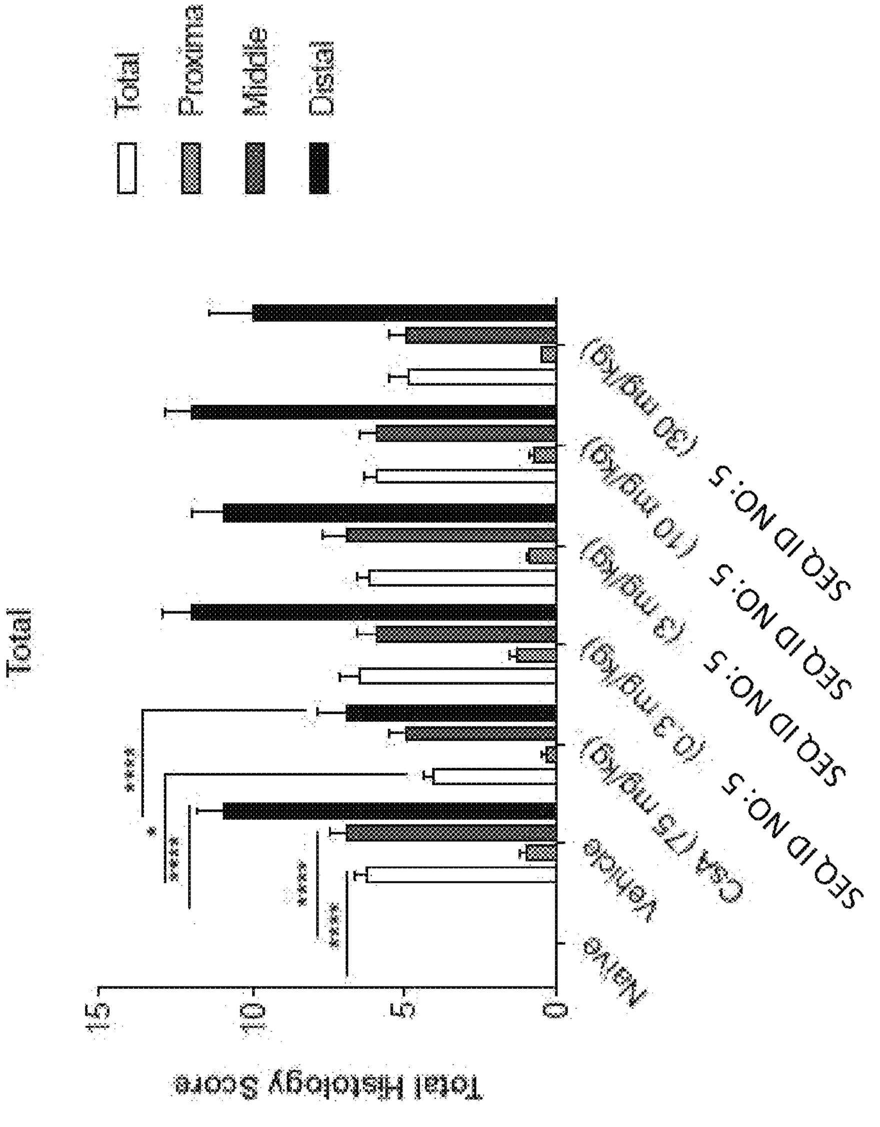
FIG. 53 illustrates the effect of the IL-10 delivery construct of SEQ ID NO. 5 on summed histology parameters (inflammation, gland loss, erosion, and hyperplasia) following DSS-induced colitis. Data are expressed as mean SEM. ****$p<0.0001$, *$p<0.05$.
Figure 54:
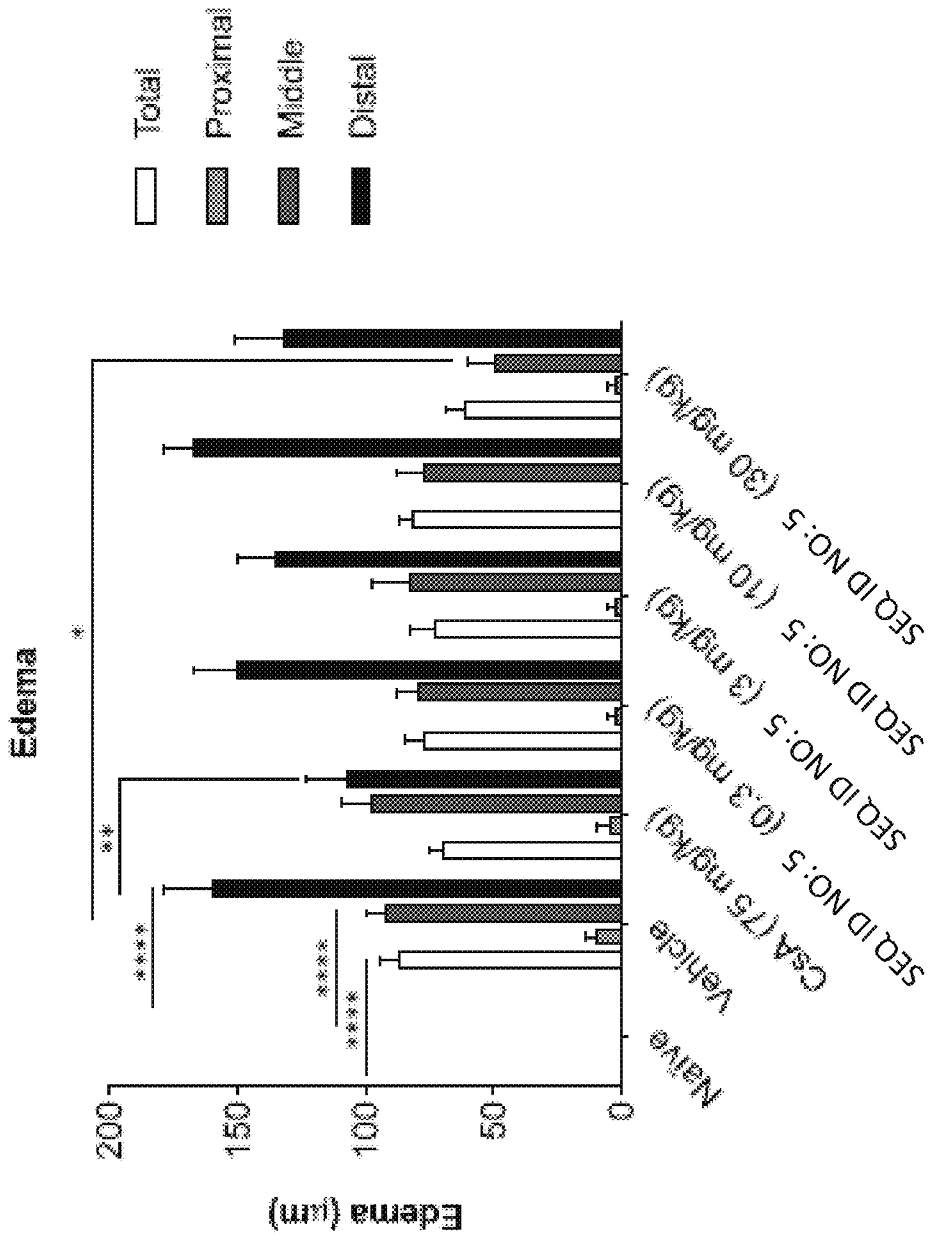
FIG. 54 illustrates the effect of the IL-10 delivery construct of SEQ ID NO. 5 on edema width following DSS-induced colitis. Data are expressed as mean SEM. **$p<0.0001$, $p<0.01$, *$p<0.05$.
Figure 55:
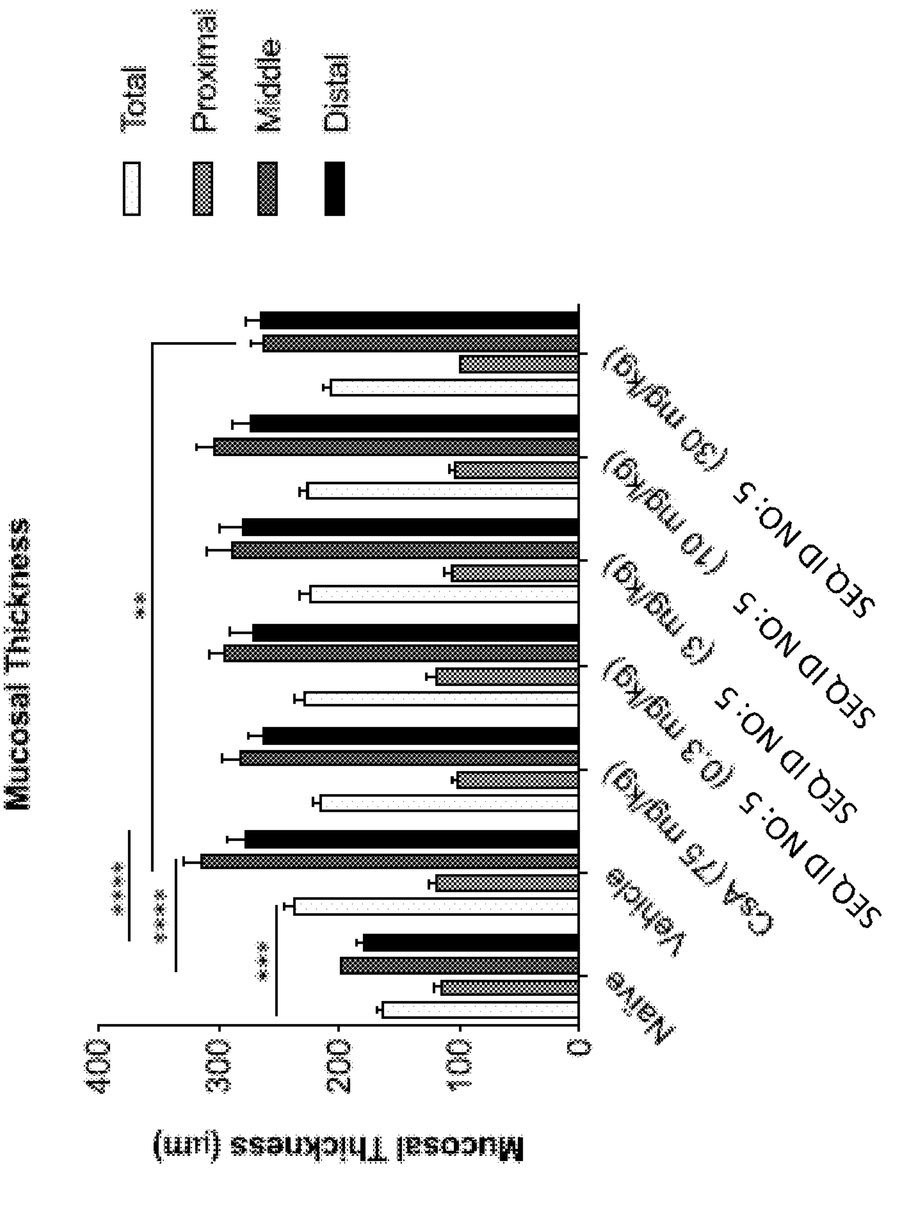
FIG. 55 illustrates the effect of the IL-10 delivery construct of SEQ ID NO. 5 on colonic mucosal thickness following DSS-induced colitis. Data are expressed as mean SEM. **$p<0.0001$, *$p<0.001$, **$p<0.01$, *$p<0.05$.
Figure 56:
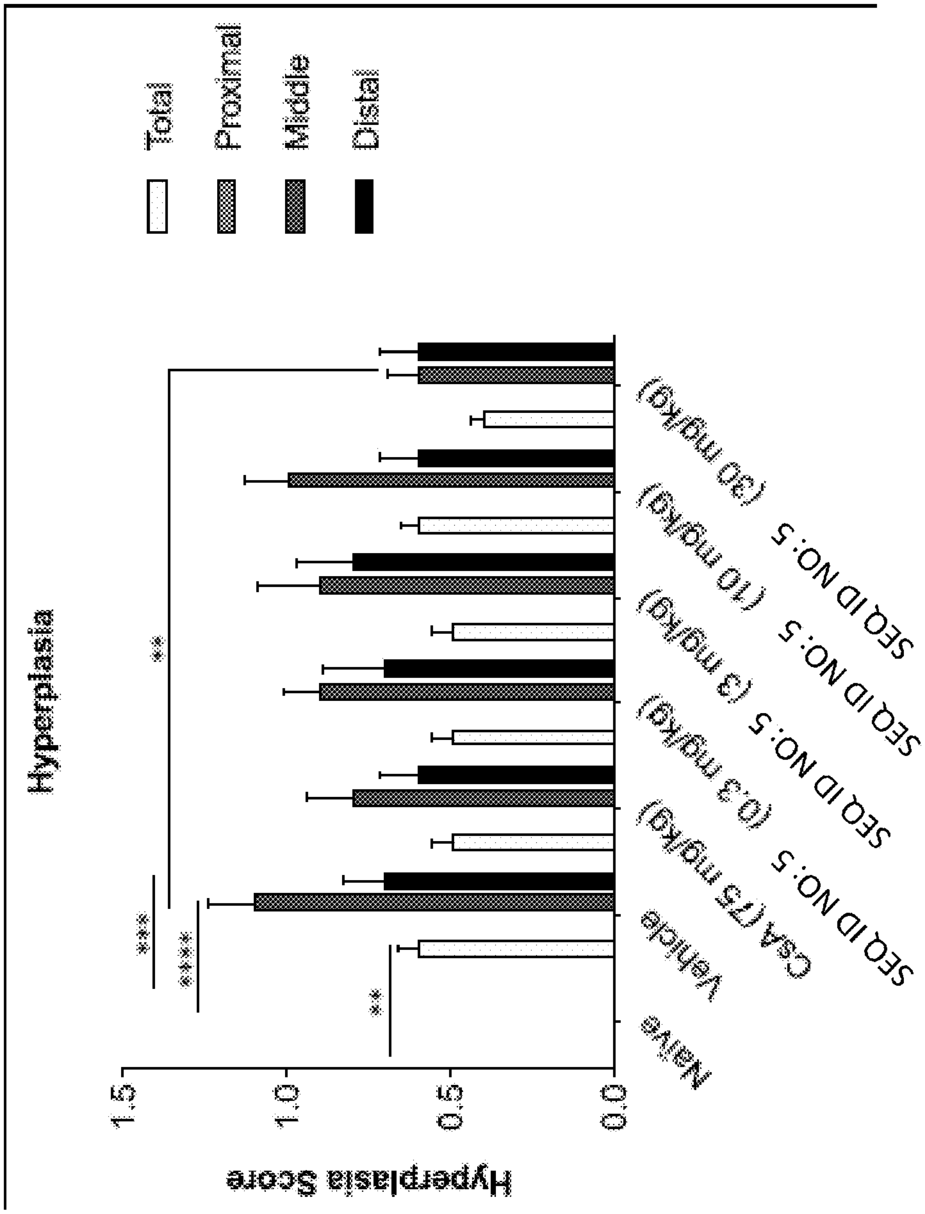
FIG. 56 illustrates the effect of the IL-10 delivery construct of SEQ ID NO. 5 on colonic hyperplasia following DSS-induced colitis. Data are expressed as mean SEM. **$p<0.0001$, $p<0.01$.

Colon histology was scored based on inflammation, gland loss, erosion and hyperplasia (max of 5 each), and these were totaled in the summary score. All four parameters were significantly increased following the DSS insult in the middle and distal colon ($p<0.05$ vs. Naïve). CsA treatment alleviated the summed score of the four parameters measured, but treatment with the IL-10 delivery construct did not reveal any significant improvements (FIG. 53). Five additional parameters (edema, neutrophil infiltration, mucosal thickness, lymphoid aggregate and lymphoid aggregate size) were also quantified. Consistent with the propagation of disease from the distal to proximal colon, histopathology was most severe in the distal colon and negligible in the proximal colon with Vehicle treatment for several parameters. Relative to Vehicle, the IL-10 delivery construct (30 mg/kg) treatment significantly improved edema width (FIG. 54), mucosal thickness (FIG. 55), and hyperplasia (FIG. 56) in the mid region. CsA did not show any clear therapeutic effects following DSS insult, with the exception of an improvement in neutrophil score ($p<0.05$ vs. Vehicle). These histological results thus indicate a mild degree of local drug efficacy.

Figure 57A:
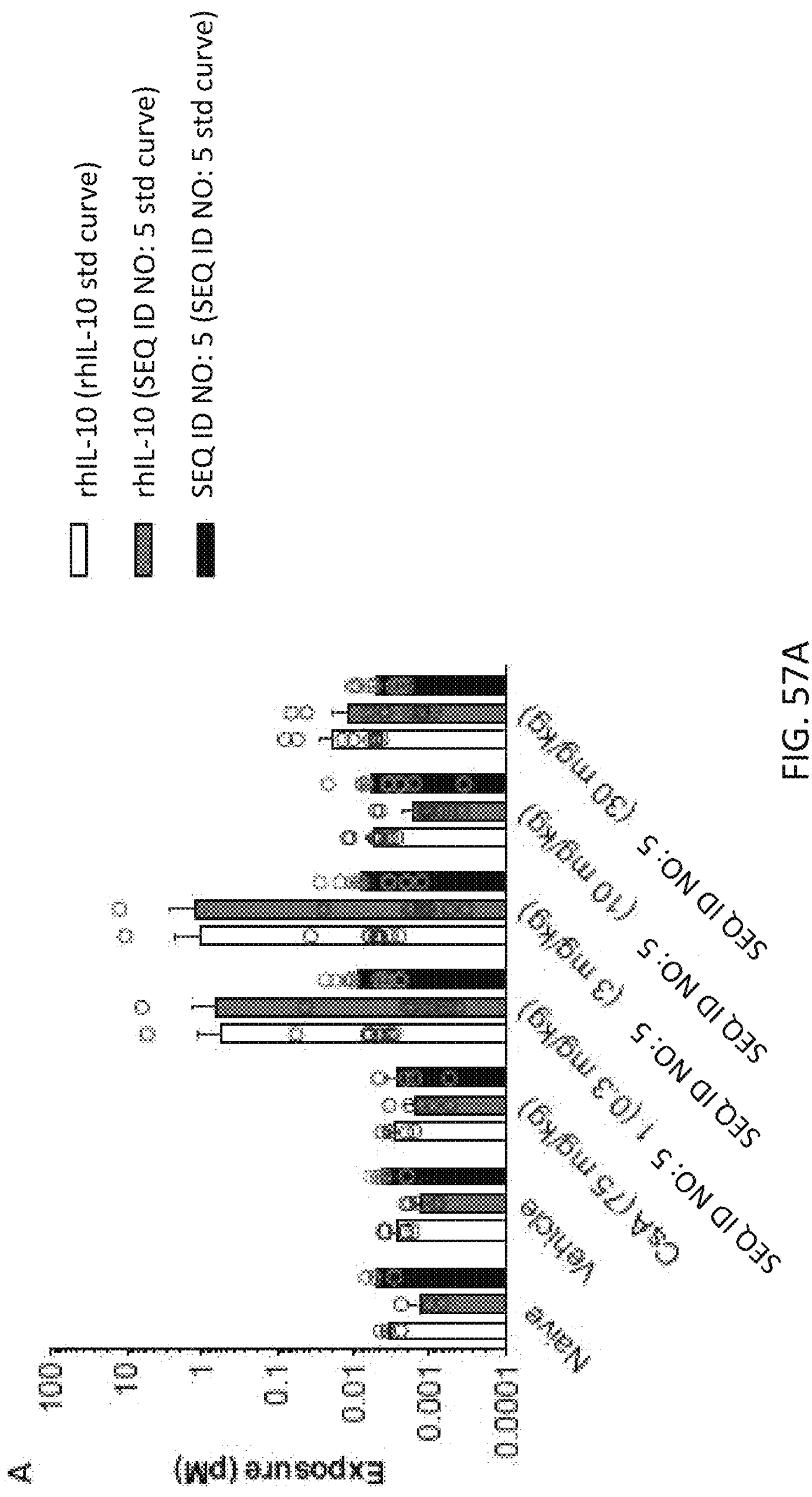
FIGS. 57A-57B illustrate variable human IL-10 detection and IL-1Ra induction in the DSS study. Systemic concentrations were measured by sandwich immunoassays following DSS insult. Data are expressed as mean SEM.
Figure 57B:
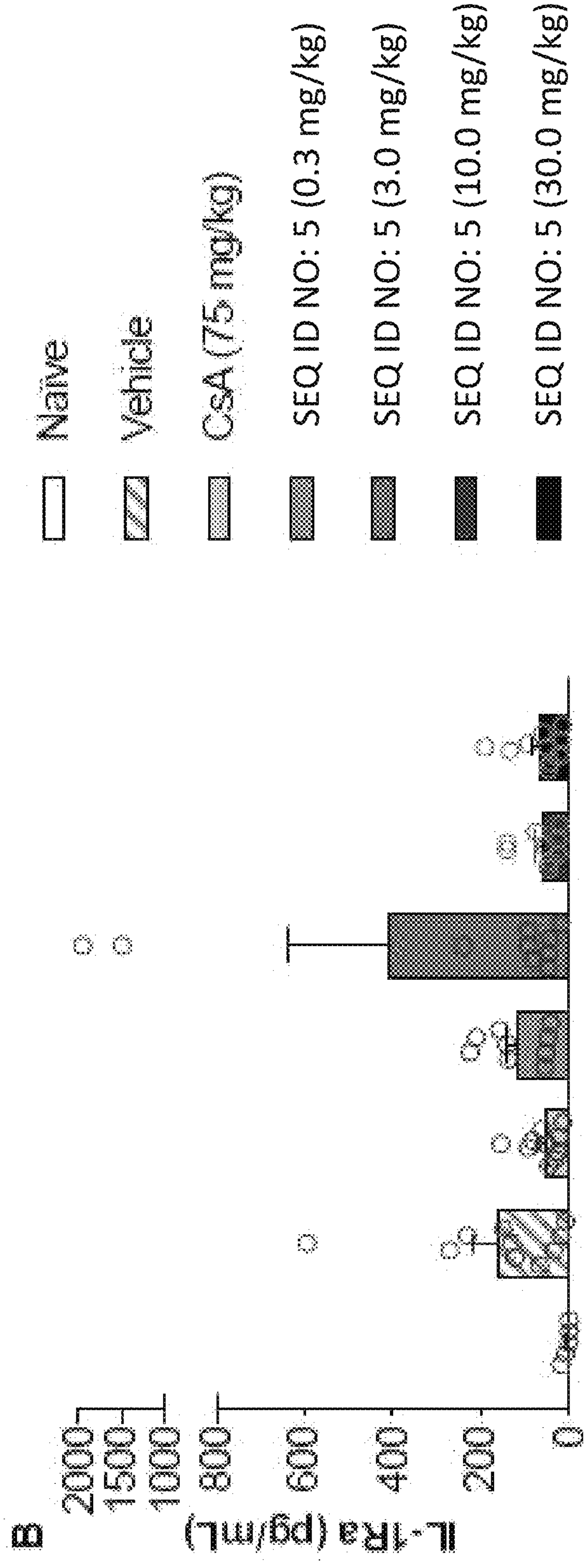

IL-10 delivery construct was detected at variable concentrations in the circulation 4 hours after the final dose in the DSS study. Levels of rhIL-10 (detected by anti-rhIL-10 capture antibody) ranged from 10-300 fold higher than the background concentrations of Vehicle treatment, in animals treated with the IL-10 delivery construct at doses of 0.3 and 3 mg/kg (FIG. 57A); however, this effect is lost with higher IL-10 delivery construct dosing. Furthermore, at the low IL-10 delivery construct doses, higher concentrations of rhIL-10 than IL-10 delivery construct (determined with the anti-cholix capture antibody) indicate the presence of IL-10 delivery construct cleavage products, which would be consistent with protease activities prevalent in the GI environment. Prophylactic treatment with the IL-10 delivery construct did not appear to influence plasma concentrations of IL-1Ra at any dose tested (FIG. 57B).

Discussion

In these studies, the efficacy of an IL-10 delivery construct (SEQ ID NO: 5) for preventing the development of inflammatory colitis in the oxazolone and DSS models was evaluated. In both studies, trends for improvement in a number of in-life and necropsy parameters were observed. Improvement in colon length at the two highest doses of the IL-10 delivery construct (10 and 30 mg/kg) following the DSS insult provided evidence for IL-10 delivery construct-dependent therapeutic effects. No mortality was present in the DSS study, whereas survival was reduced by up to 30% following oxazolone treatment, suggesting that the oxazolone protocol induced a much more severe model of colitis.

A notable feature of the DSS model was that the histopathology was more consistent between biological replicates; intra-group variability appeared to be reduced in the DSS model compared with the oxazolone model. In the DSS model, the IL-10 delivery construct at the highest dose (30 mg/kg) effectively reduced three histology parameters, namely edema width, mucosal thickness and hyperplasia, in the mid but not distal colon.

In the presented dose-response oxazolone study, efficacy was demonstrated by changes in circulating cytokine concentrations mediated by the IL-10 delivery construct. The plasma concentration of GCSF (or CSF3) was increased in response to the oxazolone insult, and this response was mitigated by prophylactic pre-treatment with 5-ASA or the IL-10 delivery construct. Pre-treatment with the IL-10 delivery construct (9.0 mg/kg dose) also prevented the production of IL-12 and IL-17, key effectors of Th1 and Th17 cells. Additionally, the IL-10 delivery construct led to a reduction in the concentrations of MCSF (9.0 mg/kg dose), IL-3 (9.0 mg/kg), IL-4 (9.0 mg/kg), IL-28 (3.0 mg/kg and 9.0 mg/kg), and IL-31 (0.3 mg/kg) to near basal (Naïve) levels. Plasma concentration for many of the cytokines analyzed were not significantly altered following oxazolone treatment. When an oxazolone-induced increase was present, the positive control 5-ASA did not effectively return the expression of the cytokine to baseline levels in many of the parameters tested. Thus, in the absence of a robust attenuation of inflammatory cytokines by 5-ASA, the suitability of this agent as a control treatment may be questioned. Additionally, this model of oxazolone-induced inflammation may not be sufficient to trigger a substantial systemic cytokine response in these mice.

IL-10 delivery construct treatment at the highest dose of 9 mg/kg revealed a trend towards augmented mRNA expression of IL-1Ra and a trend towards an increase in the IL-1Ra/IL-1β ratio in colonic tissue. Previous clinical data has demonstrated that the ratio of IL-1Ra/IL-1β inversely correlates with IBD severity, and that IL-10 can restore the IL-1Ra/IL-1β ratio. These results provide evidence for the IL-10 delivery construct treatment efficacy in this model.

Conclusion

To conclude, in the context of both oxazolone- and DSS-induced inflammatory colitis, the data presented in this report indicated that treatment with the IL-10 delivery construct (SEQ ID NO: 5) demonstrated therapeutic efficacy, as measured by improvements in inflammatory parameters in vivo. In the oxazolone study, circulating concentrations of IL-12, IL-17 and IL-28 were attenuated by treatment with the IL-10 delivery construct, which was accompanied by a trend towards an increase in the IL-1Ra/IL-1β ratio in colonic tissue.

Example 16—Oral Administration of a Single-Dose of IL-10 Delivery Construct in *Macaca fascicularis*

The non-human primate (NHP), *Macaca fascicularis*, was selected as a model system to test evaluate the preclinical efficacy, pharmacological activity and pharmacokinetics of an IL-10 delivery construct (SEQ ID NO: 5). Due to the significant genetic similarity between humans and NHPs such as the *Macaca fascicularis*, the NHP generally represents a more appropriate model for humans than the mouse, as the NHPs more closely mimic human biology and immunology. The addition of 10 mg caffeine to the IL-10 delivery construct capsules was utilized in this study to investigate capsule opening.

The objectives of this study were to: (1) evaluate the impact of single dosing at multiple levels (1, 4, 20.5 and 82 mg) by oral capsule on the pharmacokinetic profile of the IL-10 delivery construct (as measured by total IL-10 and established biomarker IL-1Ra) in *Macaca fascicularis*; (2) assess the response of the pro-inflammatory cytokines IFNγ, IL-1β, IL-2, IL-6, IL-8 and TNFα to a single oral dose at multiple levels (1, 4, 20.5 and 82 mg) of the IL-10 delivery construct by capsule in *Macaca fascicularis*; and (3) investigate the capsule performance by monitoring plasma levels of caffeine in dosed *Macaca fascicularis*, as included in the aforementioned orally dosed capsules.

Methods

IL-10 delivery constructs (SEQ ID NO: 5) and caffeine were filled by weight into size-1 Capsugel V-Cap Hydroxypropyl Methylcellulose (HPMC) capsules, for oral administration. The capsules were then successively coated in a pan spray coater with three layers of polymers. The first and third layer were thin coatings of HPMC, the first to seal the crease where the capsule shells come together, and the third to minimize sticking of the capsules to each other. The second coating layer was comprised of a 50:50 mixture of Eudragit® (Evonik Industries AG) enteric acrylic polymers FS 30 D and L 30 D-55, designed to dissolve and allow the capsule to open at pH 6.5. A summary of the test articles described, and their corresponding lot numbers is presented in TABLE 44.

TABLE 44

Summary of test articles

| Name | Description |
| --- | --- |
| 1 mg IL-10 delivery construct capsule | Size 1 enteric coated capsule containing 1 mg IL-10 delivery construct (SEQ ID NO: 5) + 10 mg caffeine |
| 20.5 mg IL-10 delivery construct capsule | Size 1 enteric coated capsule containing 20.5 mg IL-10 delivery construct (SEQ ID NO: 5) + 10 mg caffeine |

The MSD Small Spot IL-10 plate was washed 3 times with PBST before use. Standards were prepared in Diluent 2 (MSD Cat No R51BB), and samples diluted 2-fold in Diluent 2. Standards and diluted samples were added to the assay plate and the plate incubated for 2 hours at room temperature with shaking. The plate was washed 3 times with PBST and 1× SULFO TAG anti-huIL-10. Antibody was added to the plate before incubation for 1 hour at room temperature with shaking. Following a wash step, 2×MSD Read buffer was added to the wells of the plate and the plate is read in the MSD Sector Imager 600 plate reader. The lower limit of detection of each analyte is defined as 2.5 standard deviation above background.

The purpose of the IL-1Ra assay was to measure endogenous IL-1Ra in NHP plasma. The antibody pair in this sandwich immunoassay reacted with both human and NHP IL-1Ra. Samples were quantitated using an 8-point standard curve prepared from a human IL-1Ra calibrator (ranging from 5.5-4021 pg/mL, plus 0 pg/mL). Biotinylated anti-NHP IL-1Ra capture antibody was added to a MSD Small Spot Streptavidin plate and incubated for an hour at RT with shaking. Controls that represent low (16 mg/mL), mid (160 mg/mL) and high concentrations (3245 pg/mL) were prepared in pooled plasma, Standards (Calibrator 9 Blend) were prepared in Diluent 43 (MSD Cat No R50AG), and samples diluted 10 fold in Diluent 43. Standards, controls and diluted samples were added to the assay plate, and the plate incubated for 2 hours at room temperature with shaking. The plate was washed 3 times with PBST, and 1× SULFO TAG anti-IL-1Ra Antibody added to the plate. The plate was incubated for 1 hour at room temperature with shaking. Following a wash step, 2×MSD Read buffer was added to the wells of the plate, and the plate read using the MSD Sector Imager 600 plate reader. The lower limit of detection of each analyte is defined as 2.5 standard deviation above background.

In order to quantitate plasma caffeine levels, an LC-MS/MS detection system was employed. A 25-μL matrix aliquot was fortified with 25 μL of 2.00 μg/mL caffeine-trimethyl-$^{13}$C3 internal standard working solution. Analytes were isolated through supported liquid extraction (SLE). A portion of the eluate was transferred and evaporated under a nitrogen stream at approximately 45° C., and the remaining residue reconstituted with 500 μL of water/acetonitrile (95:5, v/v). The final extract was analyzed via HPLC with MS/MS detection using positive ion electrospray and reverse phase chromatography. Caffeine concentration was determined using similarly run calibration controls.

The panel of cytokines (IFNγ, IL-1β, IL-2, IL-6, and IL-8) was evaluated using a multiplex kit available from MSD. The assays in this panel were sandwich immunoassays. The MSD plate came precoated with capture antibodies on independent and pre-defined spots, and samples were quantitated against an 8-point standard curve prepared using a mixture of the cytokines (Proinflammatory Panel 1 (human) Calibrator Blend) from MSD. The standards included 0 pg/mL and these concentration ranges: IFNγ (0.37-1500 pg/mL), IL-1β (0.14-589 μg/mL), IL-2 (0.36-1490 pg/mL), IL-6 (0.18-721 pg/mL) and IL-8 (0.14-553 pg/mL).

The MSD plate (pre-coated with capture antibodies) was washed 3 times with PBST before use. Standards were prepared in Diluent 2 (MSD Cat No R51BB) and test samples diluted 2 fold in Diluent 2. Standards and diluted samples were added to the assay plate, and the plate incubated for 2 hours at room temperature with shaking. The plate was washed 3 times with PBST, and a mixture of 1×SULFO TAG detection antibodies added to the plate. The plate was incubated for 2 hours at room temperature with shaking. Following a wash step, 2×MSD Read buffer was added to the wells of the plate, and the plate read using the MSD Sector Imager 600 plate reader. The lower limit of detection of each analyte was defined as 2.5 standard deviation above background.

The purpose of the TNFα immunoassay was to quantify NHP TNFα concentration in plasma. The antibody pair in this immunoassay reacted with both human and NHP TNFα. Samples were quantitated using an 8-point standard curve prepared from a human TNFα calibrator that ranges in concentration from 5.6-4052 pg/mL and includes 0 pg/mL.

The biotinylated anti-NHP TNFα capture antibody was added to a MSD Small Spot Streptavidin plate and incubated for an hour at RT with shaking. Controls were prepared in pooled plasma, standards in Diluent 43 (MSD Cat No R50AG), and test samples were diluted 2 fold in Diluent 43. Standards, controls and diluted samples were added to the assay plate, and the plate incubated for 2 hours at room temperature with shaking. The plate was washed 3 times with PBST, and 1×SULFO TAG anti-huTNFα Antibody added to the plate. The plate was incubated for 1 hour at room temperature with shaking. Following a wash step, 2×MSD Read buffer was added to the wells of the plate, and the plate read using the MSD Sector Imager 600 plate reader. The lower limit of detection of each analyte was defined as 2.5 standard deviation above background.

Plasma samples were analyzed for Total IL-10, IL-1Ra, caffeine content and a panel of proinflammatory cytokines. Assay LLOQs were: total IL-10=0.3 pg/mL; IL-1Ra=78 μg/mL; and caffeine=25 ng; mL. Plasma concentration of IL-10 can refer to the concentration in plasma of both naturally occurring IL-10 and IL-10 appended to a carrier (for example, IL-10 in an IL-10 delivery construct described herein).

IL-10 delivery construct dosing at multiple fixed doses in non-naïve adult male *Macaca fascicularis* was conducted by Valley Biosystems (West Sacramento, Calif.). Adult NHPs were orally treated with capsules containing a fixed dose of the IL-10 delivery construct (SEQ ID NO: 5) and 10 mg caffeine (1, 4, 20.5 and 82 mg). Dosing groups are described in TABLE 45.

TABLE 45

Summary of dose groups

| Group | N | Route | Test Article | SEQ ID NO: 5 Dose | Dose per animal | Caffeine Dose |
|---|---|---|---|---|---|---|
| A | 6 per group | Oral gavage | IL-10 delivery construct + 10 mg caffeine | 20.5 mg | One capsule of 20.5 mg | 10 mg |
| B | 6 per group | Oral gavage | IL-10 delivery construct + 10 mg caffeine | 82 mg | Four capsules of 20.5 mg | 40 mg |
| C | 6 per group | Oral gavage | IL-10 delivery construct + 10 mg caffeine | 1 mg | One capsule of 1 mg | 10 mg |
| D | 6 per group | Oral gavage | IL-10 delivery construct + 10 mg caffeine | 4 mg | Four capsules of 1 mg | 40 mg |

Animals were fasted until after the 3 hour blood sample collection, when food was given. For dosing, the animals were manually restrained and a bite block placed between the jaws. A pill gun containing the dosing capsule was inserted into the back of the oral cavity and the capsule released. Up to 4 capsules were administered consecutively and a small amount of water given to induce swallowing. Once the administration of the dose was confirmed, the bite block was removed and the head released.

Blood samples were collected in $K_2$EDTA tubes from each animal pre-dose and at 0.5, 1, 2, 3, 4, 5, 6, 7, 8, and 24 hours post-dose. Animals were returned to home cages following the 2-hour sample collection. Following physical restraint, blood samples were collected via direct venous puncture using a cephalic, femoral or saphenous vein, which were processed to plasma and stored frozen at −60° C. until shipment.

Results

Figure 58:
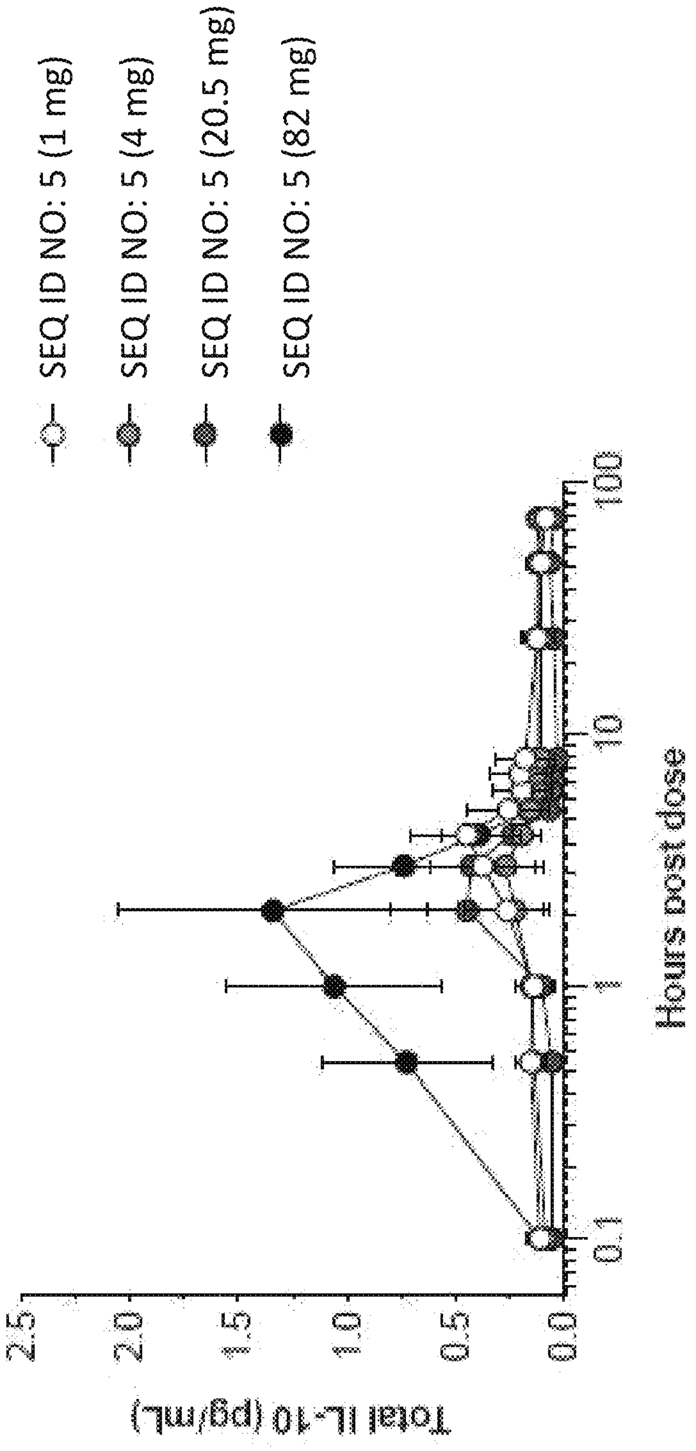
FIG. 58 illustrates plasma concentration of total IL-10 in non-human primates (NHPs) post-dose with IL-10 delivery construct (SEQ ID NO: 5). Systemic concentrations of total IL-10 measured by immunoassay following oral administration of IL-10 delivery construct capsules. Data are expressed as mean SEM.

The concentration-time profiles for total IL-10 in plasma for all dosing groups are presented in FIG. 58. Following oral administration of the IL-10 delivery construct by capsule at 82 mg (4×20.5 mg capsules), plasma concentration of total IL-10 reached a Cmax of 1.34 μg/mL at a Tmax of 2 hours post dose. Dosing with 20.5 mg (1×20.5 mg capsule) IL-10 delivery construct also resulted in a Tmax of 2 hours post dose, with a significantly lower Cmax (0.45 pg/mL) than the 82 mg dose. The Tmax for the 1 mg (1×1 mg capsule) and 4 mg (4×1 mg capsules) doses was later than the higher doses (4 hours and 3 hours respectively), and notably, the Cmax for the 1 mg dose was higher than that of the 4 mg dose (0.39 vs. 0.27 pg/mL respectively). At 6 hours post-dose, the plasma concentration of total IL-10 had returned to a baseline level.

Figure 59:
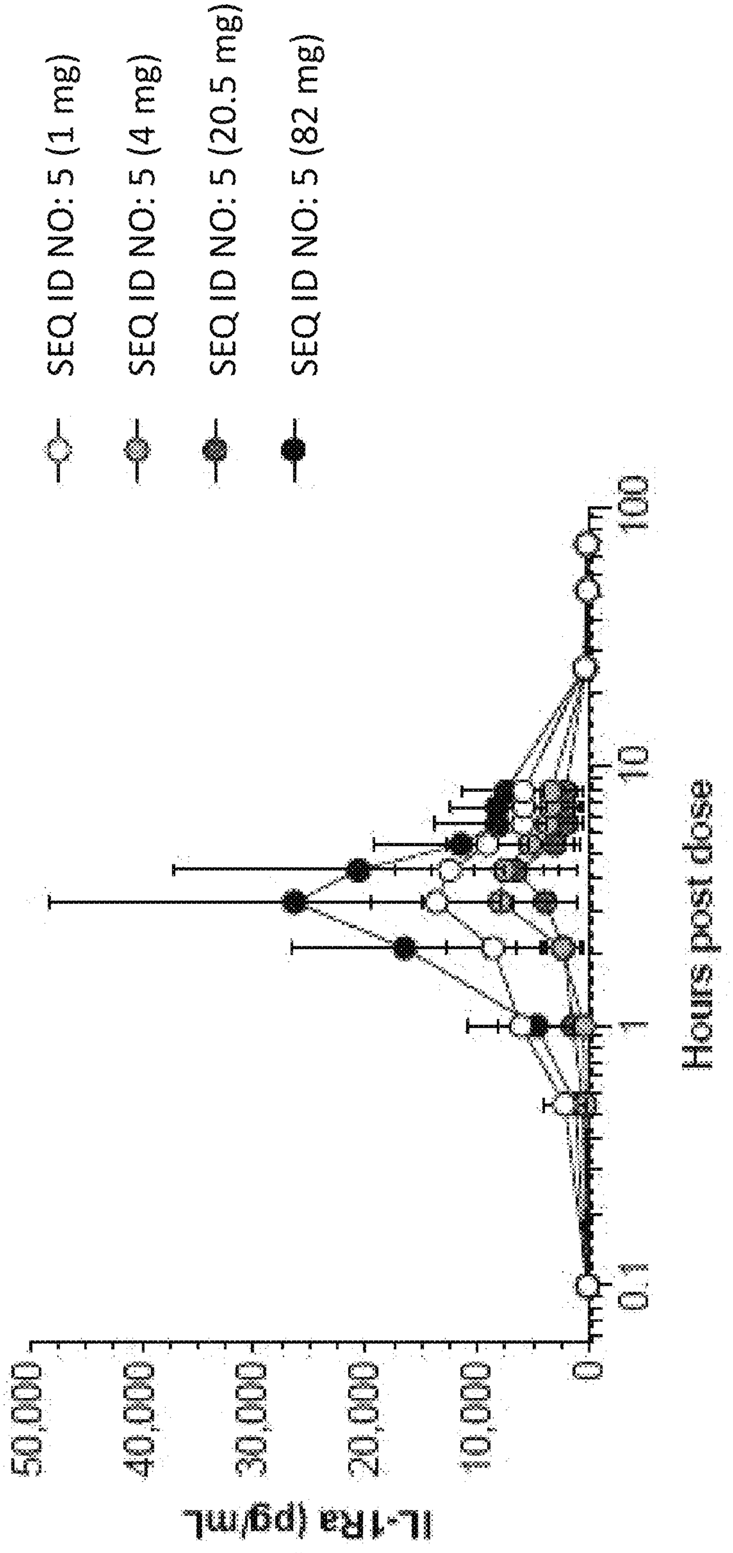
FIG. 59 illustrates plasma concentration of IL-1Ra in NHPs post-dose with the IL-10 delivery construct (SEQ ID NO: 5). Systemic concentrations of IL-1Ra measured by immunoassay following oral administration of IL-10 delivery construct capsules. Data are expressed as mean SEM.

The concentration-time profiles of IL-1Ra in plasma for all dosing groups are presented in FIG. 59. After oral dosing with 82 mg IL-10 delivery construct, NHP IL-1Ra plasma concentration reached a Cmax of 26,367 pg/mL at 3 hours post-dose. No dose response relationship was observed for Cmax across the lower dose levels (1, 4 and 20.5 mg). For all dose groups, the plasma concentration of IL-1Ra returned to baseline levels by the 24-hour post-dose timepoint.

Figure 60:
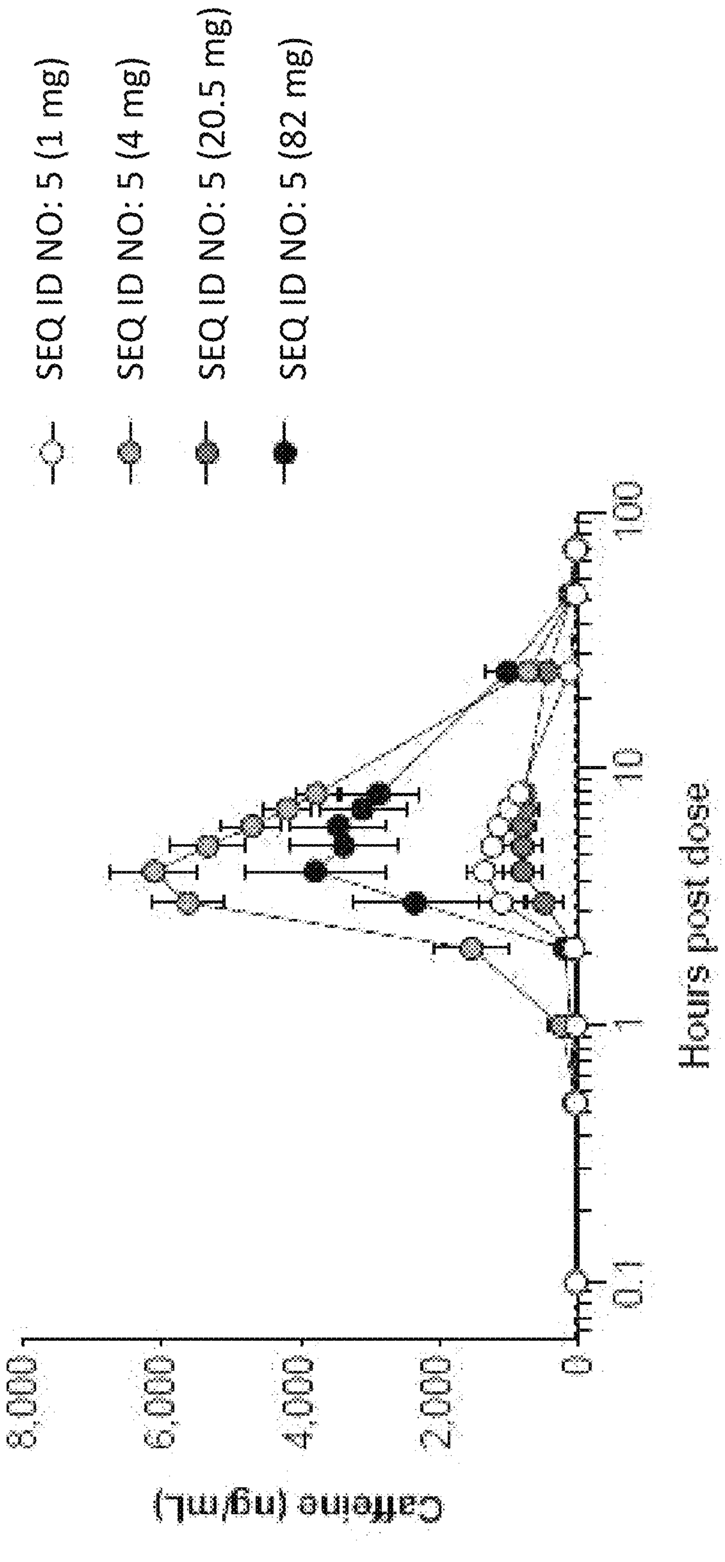
FIG. 60 illustrates plasma concentration of caffeine in NHPs pose-dose with the IL-10 delivery construct (SEQ ID NO: 5). Systemic concentrations of caffeine measured by immunoassay following oral administration of IL-10 delivery construct capsules. Data are expressed as mean SEM.

The plasma concentration of caffeine in NHPs following a single dose with IL-10 delivery construct/caffeine capsules as specified in TABLE 45 is presented in FIG. 60. It should be noted that animals in the 1 mg (1×1 mg capsule) and 20.5 mg (1×20.5 mg capsule) dosing groups each received a 1×10 mg dose of caffeine, while animals administered the 4 mg (4×1 mg capsules) and 82 mg (4×20.5 mg capsules) doses each received a 4×10 mg dose of caffeine. This explains the significantly higher $C_{max}$ of caffeine seen for the 4 and 82 mg dosing groups (6117 ng/mL and 3793 ng/mL respectively) than for the 1 and 20.5 mg dosing groups (1352 ng/mL and 800 ng/mL respectively). Absorption of caffeine was observable 2-3 hours post dose (demonstrating opening of capsules) and the Tmax for all doses was 4 hours post dose.

Figure 61A:
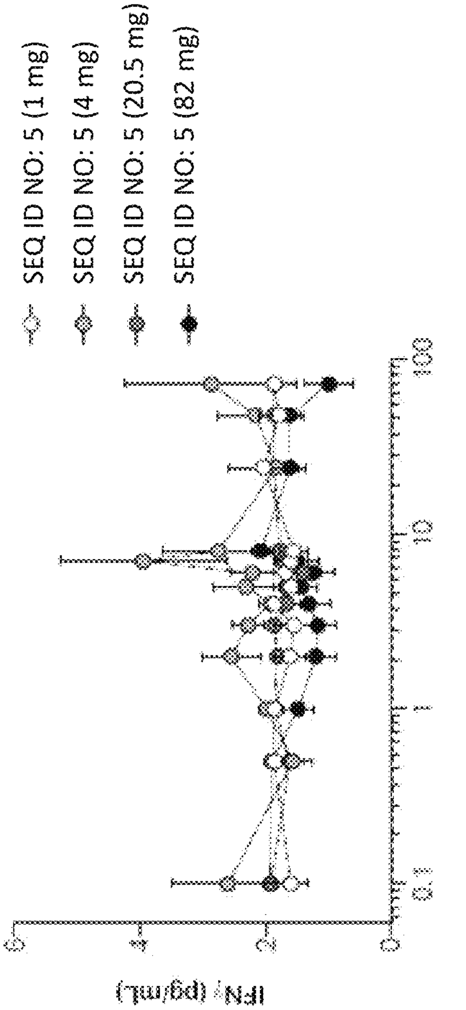
FIGS. 61A-61E illustrate plasma concentrations of selected proinflammatory cytokines in NHPs after oral dosing with the IL-10 delivery construct (SEQ ID NO: 5).
Figure 61B:
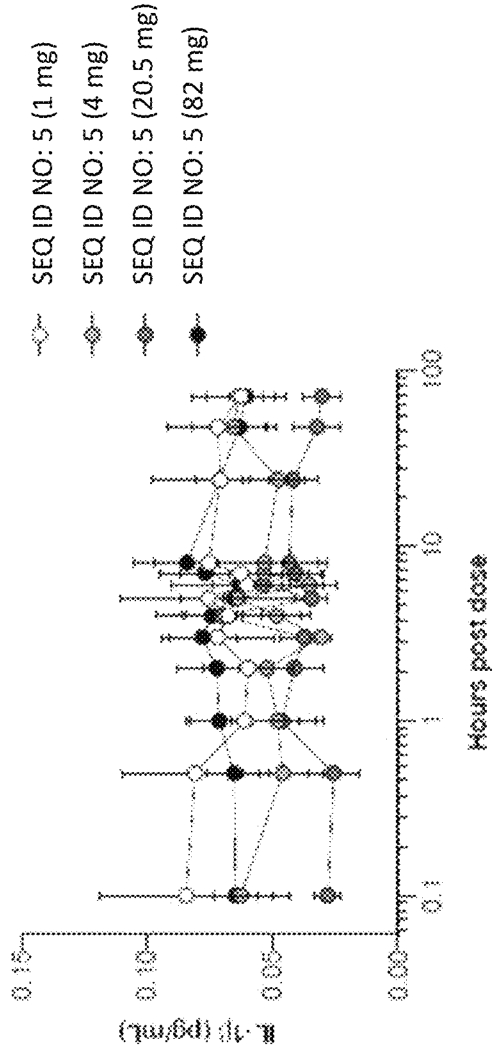
Figure 61C:
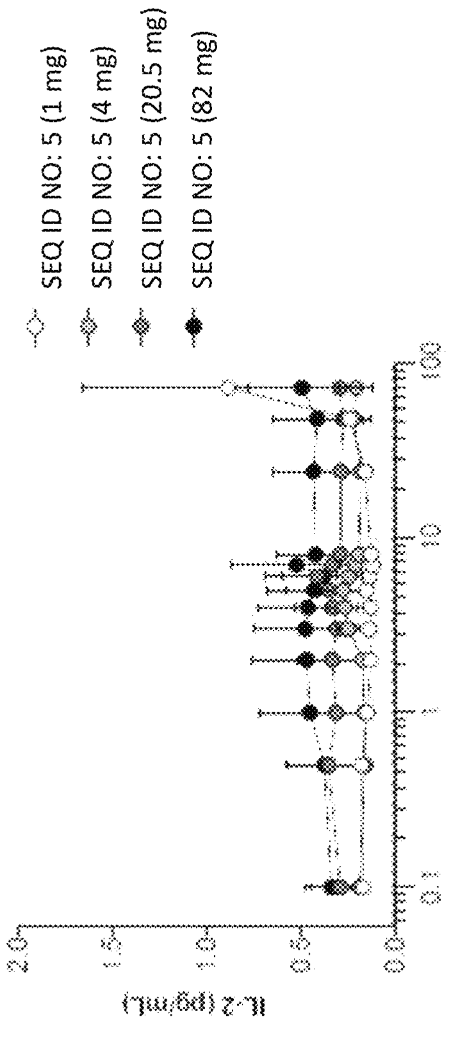
Figure 61D:
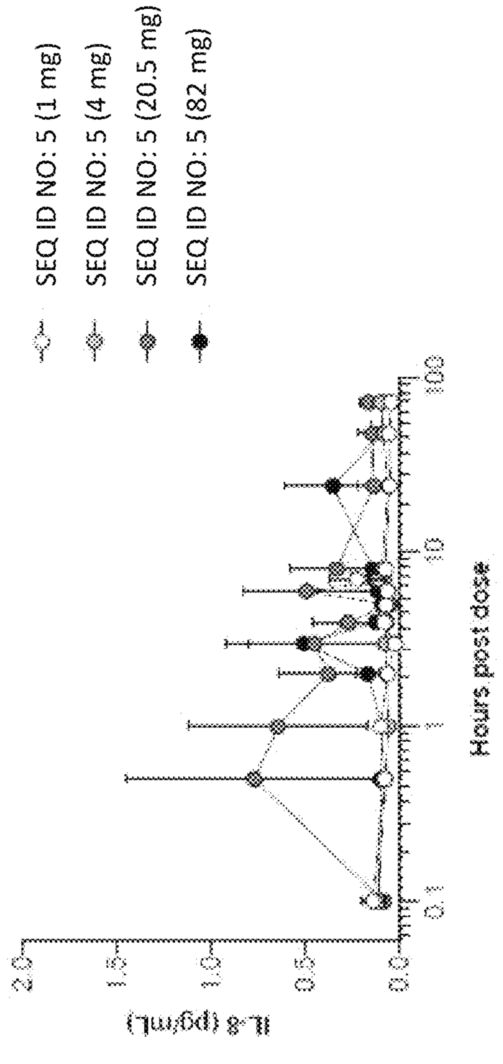
Figure 61E:
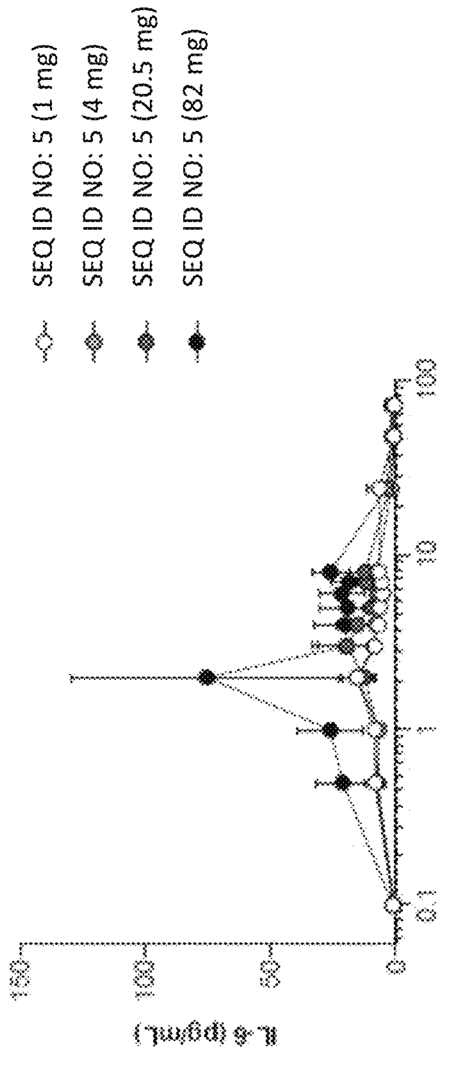

Administration of IL-10 delivery construct (SEQ ID NO: 5) capsules was not associated with any consistent trends in plasma IFNγ (FIG. 61A), IL-1β (FIG. 61B), IL-2 (FIG. 61C), IL-8 (FIG. 61D), or IL-6 levels (FIG. 61E), although high variability and marked influence of outliers on the mean values for individual timepoints were observed for plasma IFNγ, IL-2, IL-6 and IL-8. Similar quantitation of TNFα showed no induction as signals for all samples were below the limit of detection (data not shown).

Additionally, plasma levels of IL-10, IL-1Ra, and IFN-γ were assessed following administration of IL-10 delivery construct (SEQ ID NO: 5) capsules was compared with intravenous administration of the IL-10 delivery construct (SEQ ID NO:5) (FIGS. 104A-104C). Oral delivery of the IL-10 delivery construct (SEQ ID NO:5) in non-human primates via enteric-coated capsules increased IL-1Ra without significant induction of IFN-γ.

Discussion and Conclusions

The systemic concentration of the IL-10 delivery construct (as measured by total IL-10) increased significantly above baseline levels at all dose levels (1, 4, 20.5 and 82 mg), and returned to baseline levels within six hours of dose administration. There appeared to be no clear dose relationship for total IL-10 exposure, although the highest dose of the IL-10 delivery construct (82 mg) resulted in the highest $C_{max}$. IL-1Ra was induced by IL-10 delivery construct administration in all dosing groups with no clear dose relationship although, as for total IL-10, the highest dose of the IL-10 delivery construct (82 mg) resulted in the highest $C_{max}$.

Plasma caffeine concentration was used as a marker for capsule opening and performance. Absorption of caffeine was observable 2-3 hours post dose (demonstrating opening of capsules) and the Tmax for all doses was 4 hours post dose.

Administration of the IL-10 delivery construct capsules was not associated with any consistent trends in plasma IFNγ, IL-1β, IL-2, IL-6 or IL-8 levels.

Example 17—Cell Targeting in the Lamina Propria

Male adult (7-8 week old) Wistar rats with an average weight of about 250 g were used to perform in vivo studies examining cell targeting in the lamina propria of an IL-10 delivery construct (SEQ ID NO: 5). Rats were anesthetized using inhaled isoflurane and euthanized by inhaled $CO_2$.

Experiments were initiated by making an approximately 4 cm abdominal incision to access the mid-jejunum region of the small intestine. After performing the incision, 50 μl of a prepared solution of the IL-10 delivery construct (typically at about 1 mg/mL) was injected into the intestinal lumen of an area devoid of foodstuffs through a 27-gauge needle using a 1 mL syringe. The mesentery adjacent to the site of injection was labeled with a marker and the intestine was returned to the abdominal cavity, with the incision being closed with clamps.

At specific times, the injected intestine was retrieved, surgically isolated and flushed with a 4° C. isotonic PBS. Washed, excised samples were fixed (4% paraformaldehyde in PBS) overnight at 4° C. before dehydration through graded series of ethanol/water solutions and overnight incubation in chloroform.

Dehydrated tissues were immersed in wax, sectioned, and mounted on poylysine slides and processed for antigen retrieval using sodium citrate. Afterward, sections were permeabilised with 0.2% Triton-X100 in PBS prior to thrice washing in PBS and blocking with 2% BSA+2% serum of the animal the secondary antibodies have been raised. Primary antibodies were diluted in 1% BSA, 0.1% Triton-X100 in PBS and incubated overnight at 4° C. in humidified air. Fluorescent secondary antibodies were diluted in 1% BSA, 0.1% Triton-X100 in PBS and incubated for 2 h at RT prior to processing for confocal microscopy. On occasion, an approximately 1 cm section of intestine at the injection site was collected for biochemical studies.

Proteins for specific cell types were examined by immuno-fluorescence using confocal microscopy. The IL-10 delivery construct components (the carrier, also referred to herein as "cholix," and IL-10) were followed separately with either a polyclonal antibody (pAb) or monoclonal antibody (mAb) to IL-10 or a pAb or mAb to the carrier domain to allow co-localization with pAb or mAbs available (TABLE 46).

TABLE 46

Summary of pAbs and mAbs

| Target | pAb/mAb | Species reactivity | Host | Dilution for IHC (P) | Cells labeled | Cat. # |
|---|---|---|---|---|---|---|
| Carrier | pAb | | Rabbit | 1/500 | | |
| IL-10 | pAb | Human | Goat | 1/25 | | Ab10775 |
| CD11c | | | | | Dendritic cells | |
| CD19 | mAb | Mouse | Mouse | | B cells | Ab25177 |
| CD34 | mAb | Mouse, Human | Mouse | 1/500 | Endothelia | Ab187282 |
| CD3 | mAb | Rat | Mouse | | T cells | Ab185763 |

Figure 62:
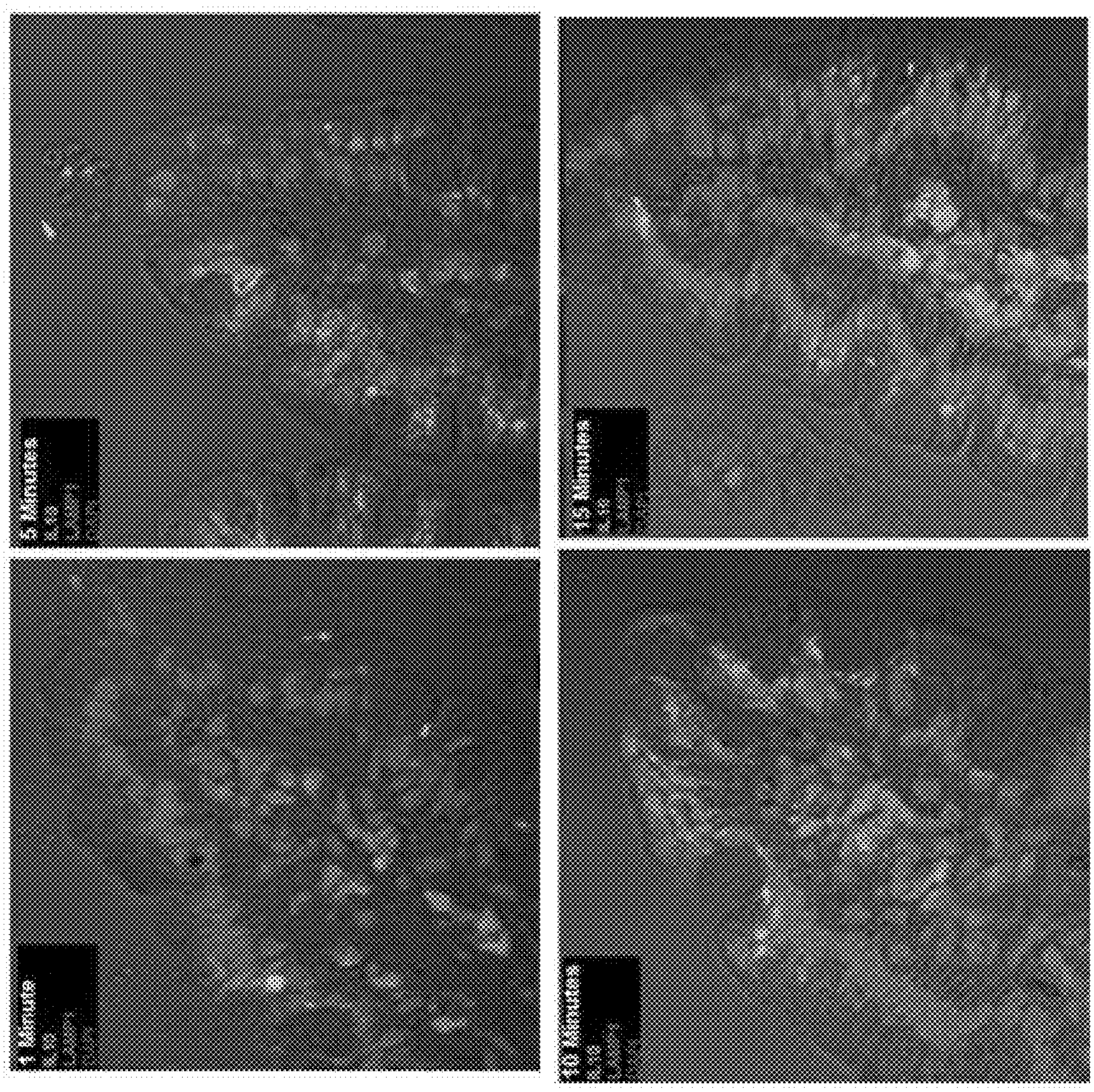
FIG. 62 illustrates that the IL-10 delivery construct showed little or no co-localization with LAMP1-positive lysosomes in enterocytes over a 15-minute time course study.

The IL-10 delivery construct showed little or no co-localization with LAMP1-positive lysosomes in enterocytes, but did collect within cells of the lamina propria there consistent with their ultimate consumption where this protein was directed to lysosomes (FIG. 62). A 1-minute pulse was performed, followed by a time course study that verified by 15 min an extensive amount of the IL-10 delivery construct reached the lamina propria and entered into cells targeted by the carrier component of this construct.

Figure 63:
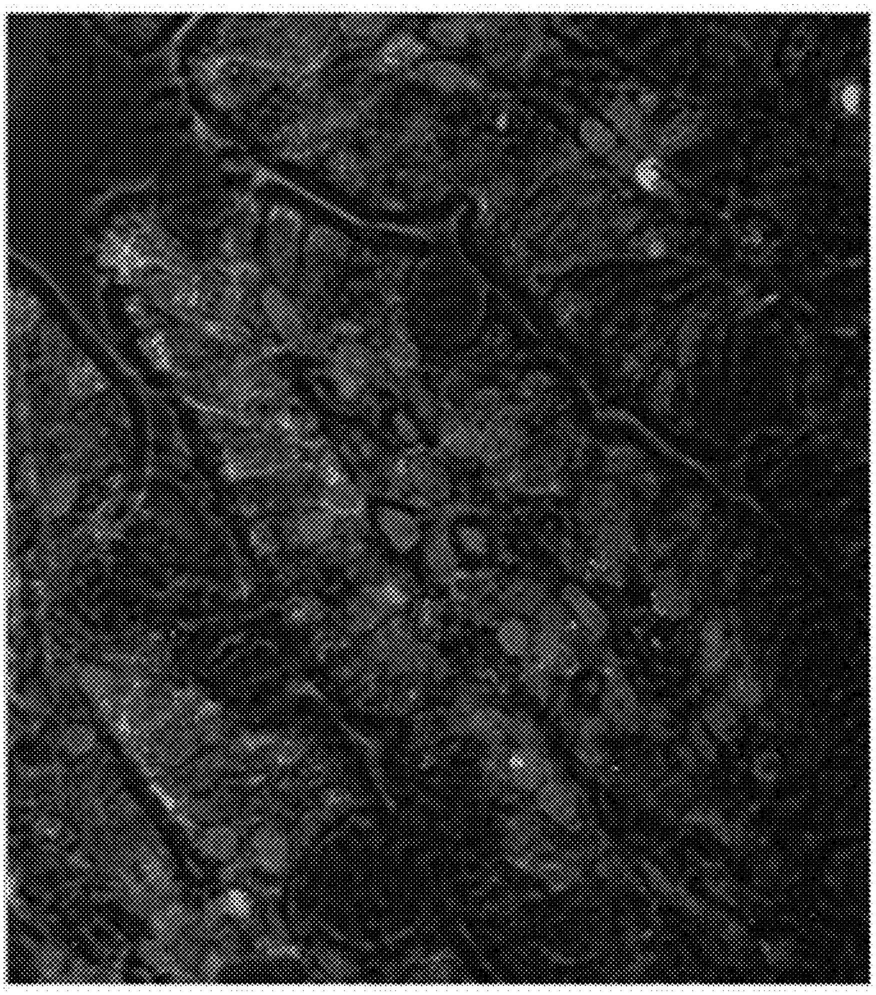
FIG. 63 illustrates an immuno-fluorescence image of CD11c containing cells (dendritic cells) and IL-10.

CD11c antigen labeled a sparse set of cells (e.g. dendritic cells) within the lamina propria of the rat jejunum. The IL-10 delivery construct did not co-localize with CD11c antigen to any striking extent (FIG. 63). Interestingly, vesicles near the apical surface of enterocytes co-labeled for CD11c and IL-10, suggesting an interaction between the carrier protein and a vesicular compartment that harbored this antigen.

Figure 64:
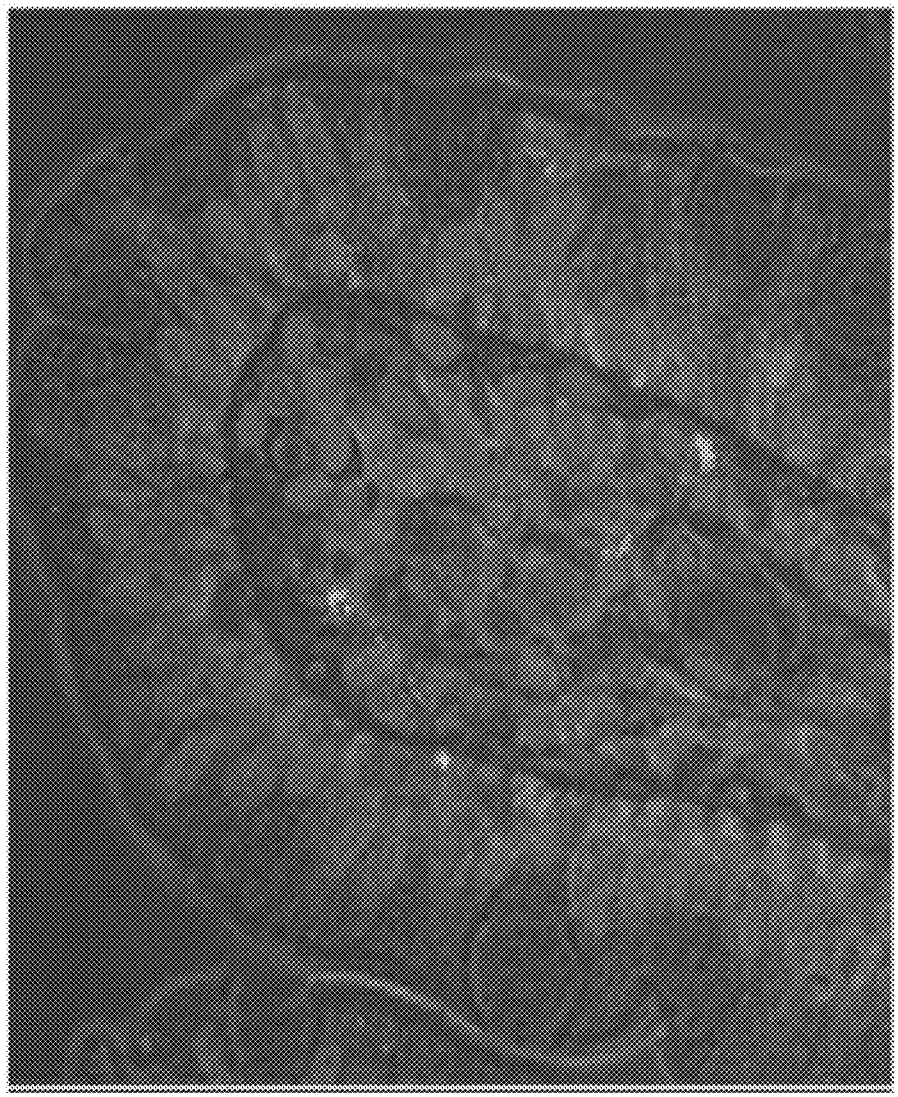
FIG. 64 illustrates an immuno-fluorescence image of CD19 containing cells (B lymphocytes) and IL-10.

The IL-10 delivery construct failed to co-localize with the few CD19-positive cells (e.g. B-lymphocytes) within the lamina propria (FIG. 64).

Figure 65:
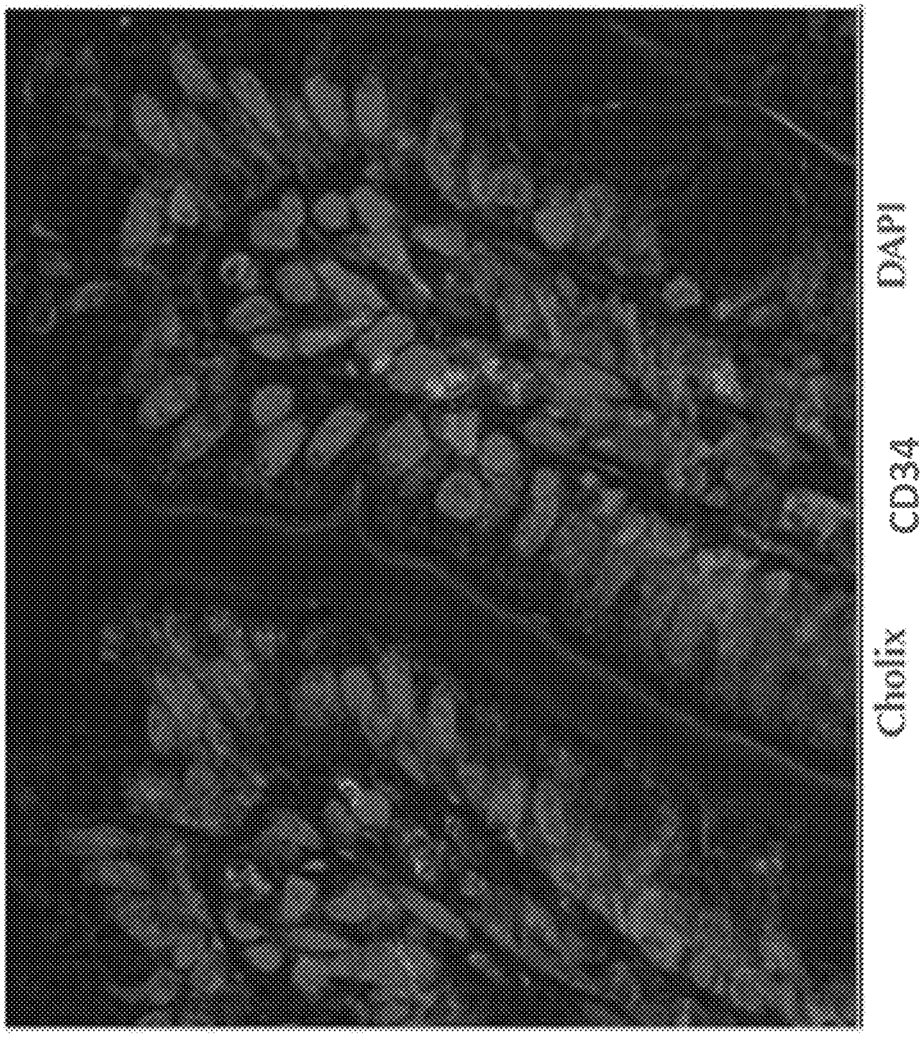
FIG. 65 illustrates an immuno-fluorescence image of CD34 containing cells (endothelia) and cholix.

The IL-10 delivery construct failed to co-localize with the few CD34-positive cells (e.g. endothelia) within the lamina propria (FIG. 65).

Figure 66:
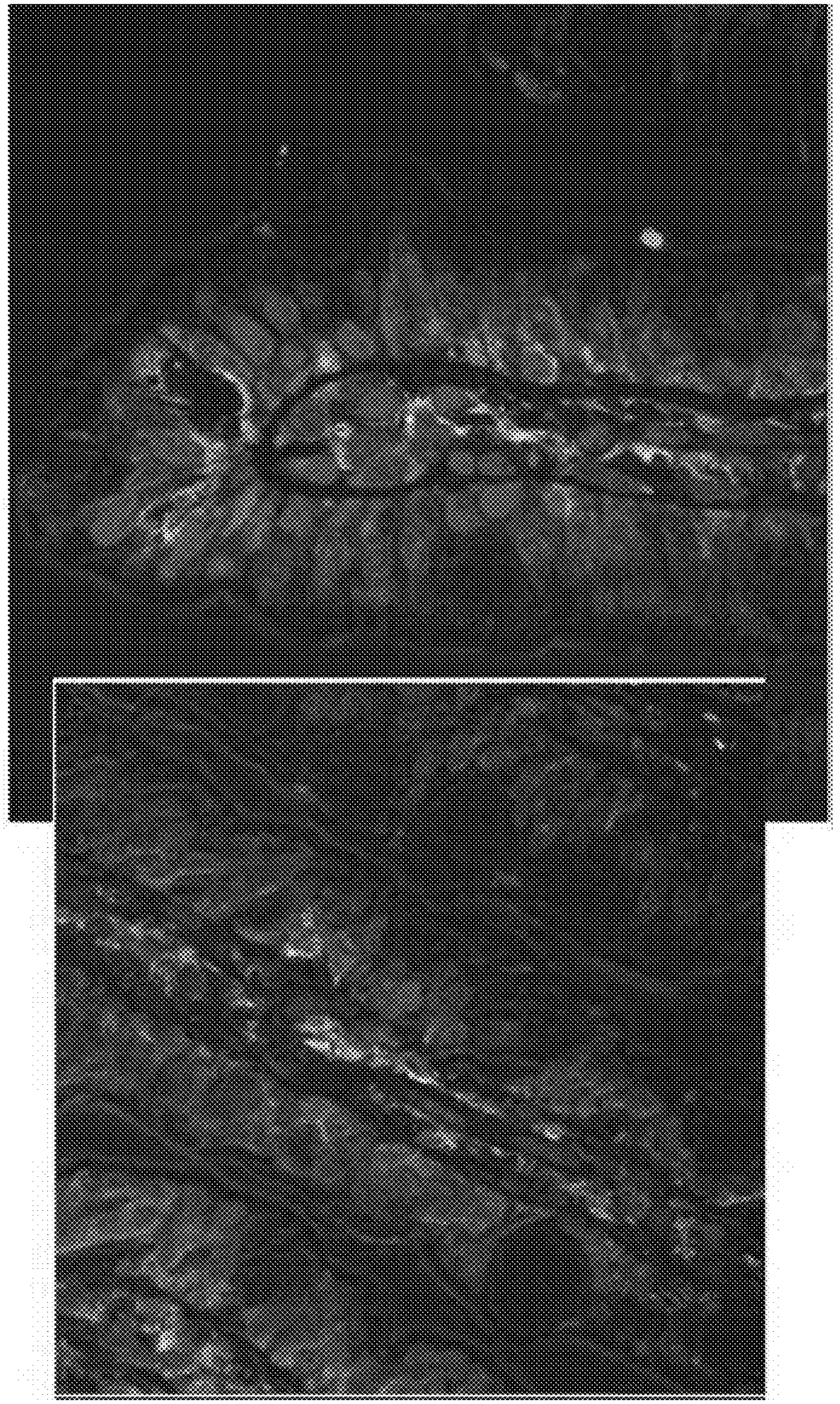
FIG. 66 illustrates an immuno-fluorescence image of CD3 containing cells (T lymphocytes) and IL-10.

The IL-10 delivery construct demonstrated striking co-localizations with the CD3 antigen, suggesting significant targeting of the carrier protein to T lymphocytes within the lamina propria (FIG. 66). Additionally, cells consistent with intra-epithelial lymphocytes were also a site of co-localization.

Cells within the lamina propria of mouse jejunum showed some of the same targeting outcomes as that observed for rat. The complication of these studies, however, is the ability of human IL-10 to be recognized by the mouse IL-10 receptor, leading to two potential cellular fates in some cases.

In conclusion, the carrier in the IL-10 delivery construct used to facilitate the transcytosis of human IL-10 across enterocytes appears to access a select population of cells within the lamina propria. The fate of the carrier within these targeted cells appears to intersect with a LAMP1-positive compartment that is most likely the lysosome, suggesting its apparent local destruction within the lamina propria. T-lymphocytes appear to be the largest cell type present within the lamina propria that were targeted by the carrier used in the IL-10 delivery construct.

Example 18—Comparison of Tablets Vs. Capsules

To evaluate the drug release from IL-10 delivery construct (SEQ ID NO: 5) capsules, and to compare the performance to those of tablets, IL-10 delivery construct (SEQ ID NO: 5) capsules were obtained with various coating conditions, from HPMC coating only to Eudragit coating at different weight gain.

Figure 68:
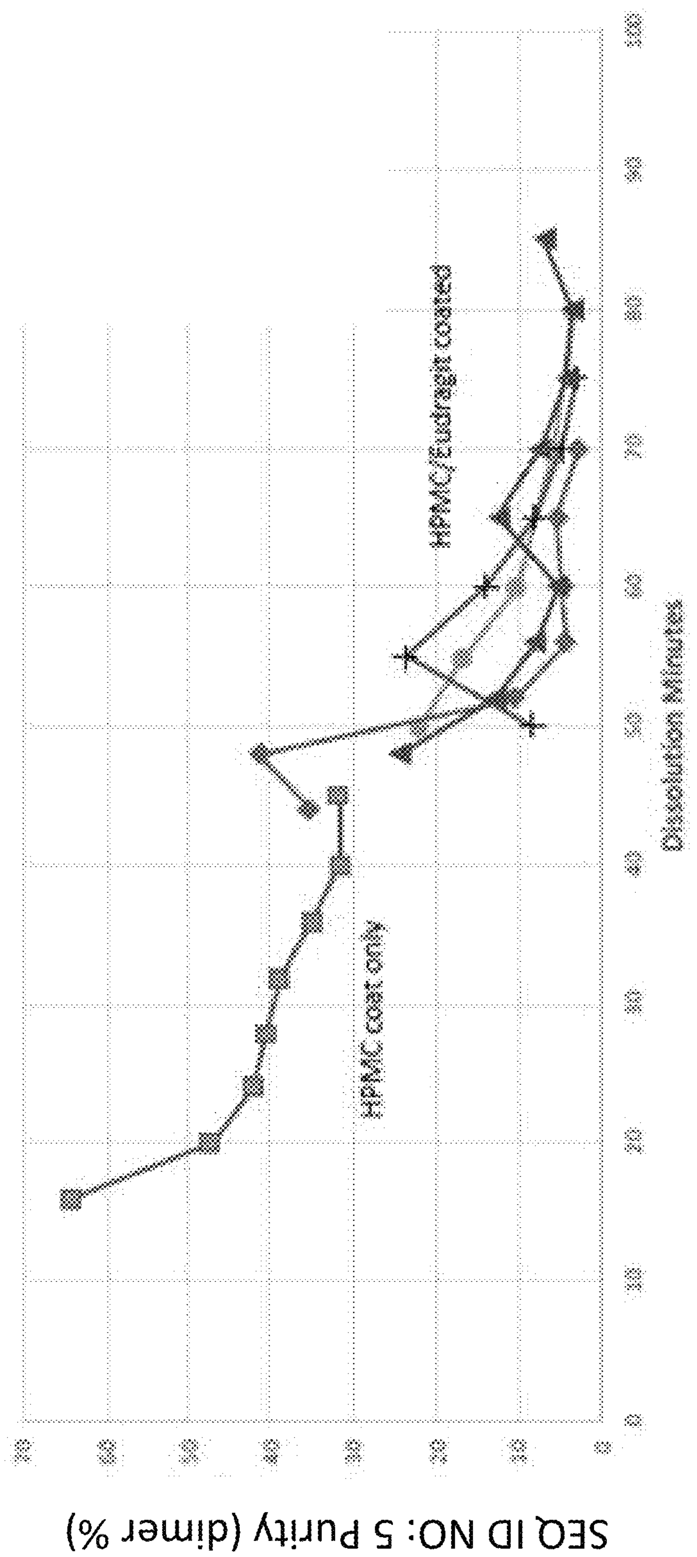
FIG. 68 illustrates dissolution of coated capsules containing the IL-10 delivery construct in a Type 4 dissolution apparatus. Symbol key: squares: HPMC sub coating only; circles: HPMC sub coating plus eudragit 50:50 coating for 80 min; plus signs: HPMC sub coating plus eudragit 50:50 coating for 120 min; diamonds: HPMC sub coating plus eudragit 50:50 coating for 120 min plus HPMC coating for 20 min; and triangles: HPMC sub coating plus eudragit 50:50 coating for 120 min plus HPMC coating for 60 min.

Capsules with only HPMC coating showed significantly higher IL-10 delivery construct (SEQ ID NO: 5) dimer purity and concentration compared to those with enteric coating. While, as expected, the presence of Eudragit coat caused delayed release of IL-10 delivery construct (SEQ ID NO: 5), the impact on dimer purity and quantity of active drug released contrasts with the results obtained for HPMC coated tablets under the same dissolution conditions (FIG. 68). Dissolution of size 1 HPMC capsules containing 20 mg of the IL-10 delivery construct (SEQ ID NO: 5) and coated with varying amounts (from about 10 mg to about 35 mg) of 50:50 coat weight ratio of Eudragit® L30D55: Eudragit® FS30D was examined. The Eudragit coating delayed release of the IL-10 delivery construct from the capsule but had a negative effect on IL-10 delivery construct dimer purity (dimer %) (FIG. 68). Dissolution was measured on a Type 4 dissolution apparatus, flow-through mode, in pH 7.0 dissolution buffer at 37° C. The in vitro dissolution test which is used for these determinations is one of several that are standard in the art, particularly for extended release tablets e.g. see USP <711> Dissolution or Ph. Eur. 2.9.3. Testing for the IL-10 delivery construct is conducted in USP Apparatus 4 (a flow-through cell apparatus, open mode, in pH 7.0 dissolution buffer at 37° C.). Individual tablets are placed in the apparatus and sampling is conducted at the specified times (e.g. 10, 20, 30 and 60 min). The sampling was conducted by collecting flow through solution from the tubing leading to waste bottle. The sample solution in was kept in vials on ice before SEC HPLC analysis. At each timepoint, the concentration of the IL-10 delivery construct in the fluid sample is determined (e.g. by a validated HPLC method), thereby permitting calculation of the amount which has been released from a tablet.

Figure 69:
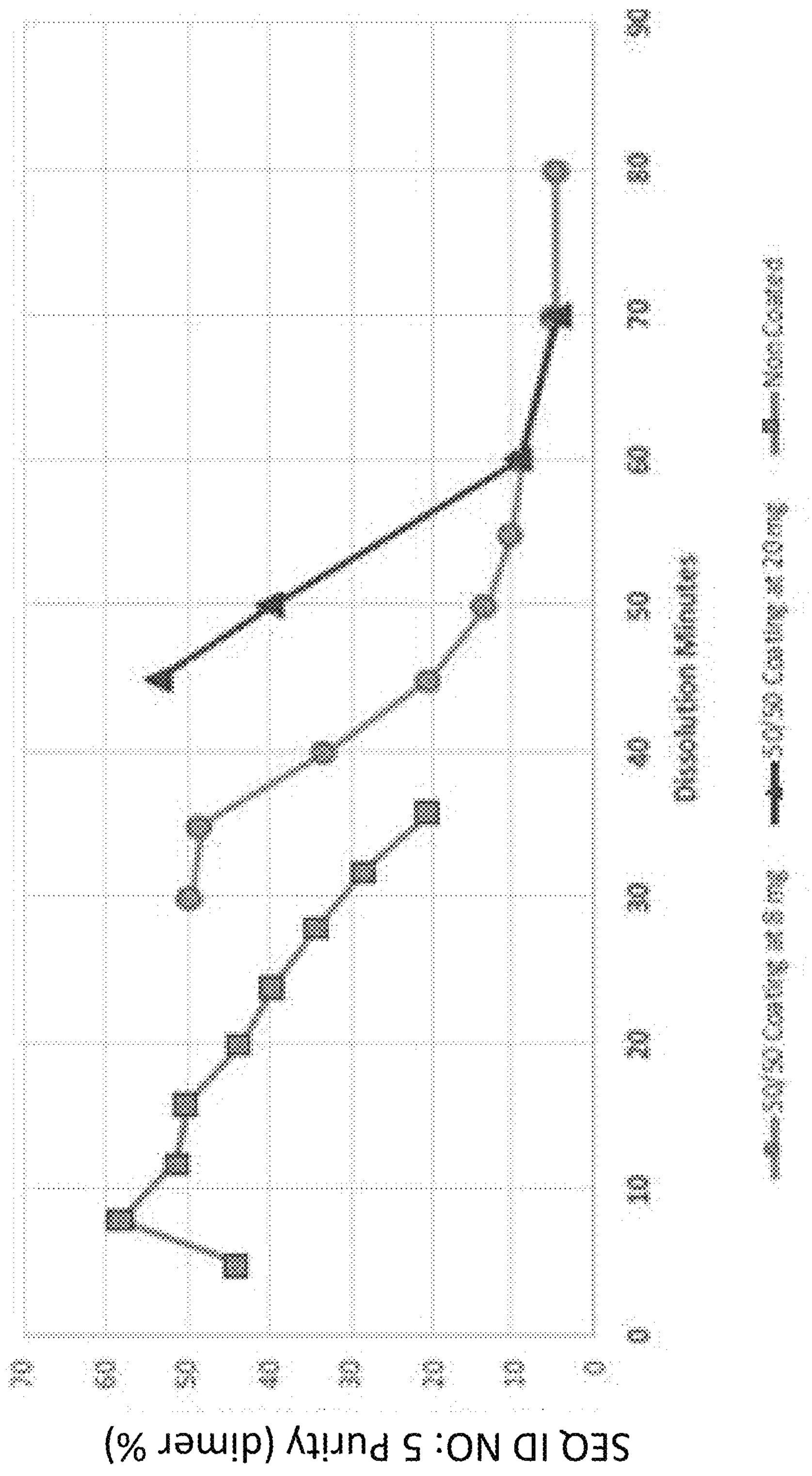
FIG. 69 illustrates dissolution of coated tablets containing the IL-10 delivery construct in a Type 4 dissolution apparatus.

In contrast, for tablets, the Eudragit coating delayed release of the IL-10 delivery construct from the tablet without impacting the IL-10 delivery construct dimer purity (dimer %) (FIG. 69). Tablets were of the F3 tablet formulation, with an IL-10 delivery construct strength of 6 mg, spray coated with HPMC, and then had a coat weight ratio of 50:50 of Eudragit® L30D55: Eudragit® FS30D. Two different Eudragit coat weights were examined (8 mg and 20 mg). Dissolution was measured on a Type 4 dissolution apparatus, flow-through mode, in pH 7.0 dissolution buffer at 37° C.

Figure 70:
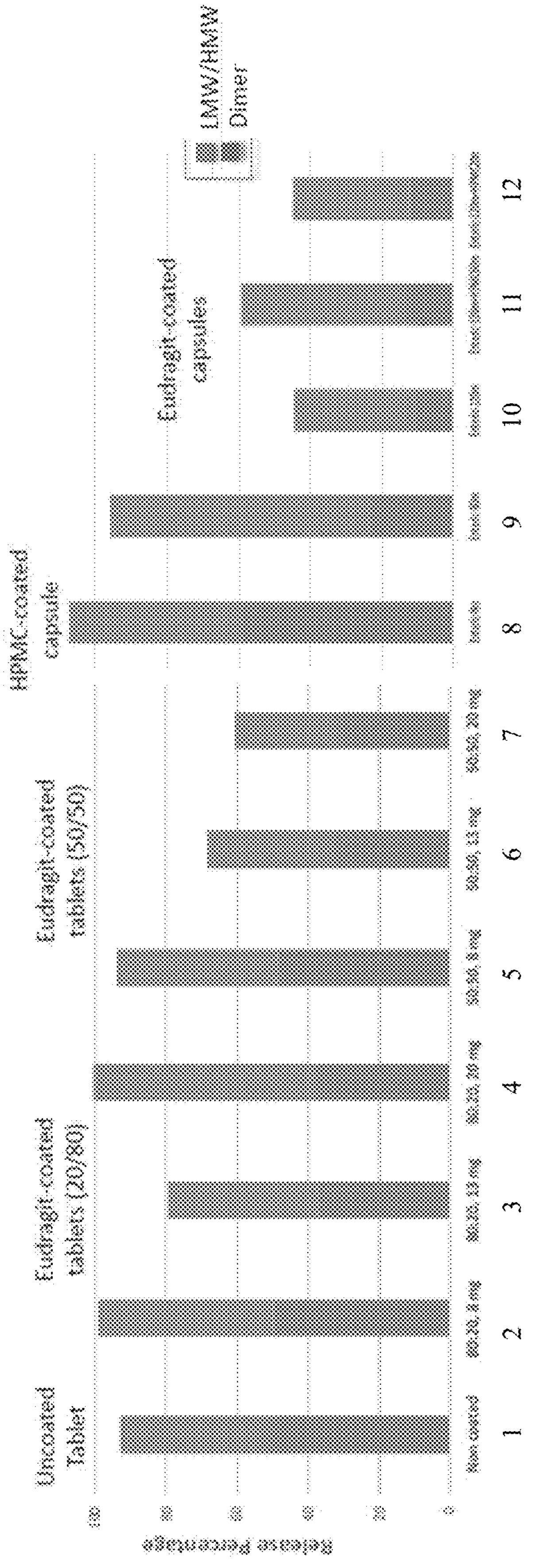
FIG. 70 illustrates recovery of dimer forms of the IL-10 delivery construct (lower section of each bar) as well as monomer (LMW) and aggregate (HMW) forms (upper section of each bar) of the IL-10 delivery construct across the full time course shown in FIG. 68 and FIG. 69. Data illustrates the area-under-the-curve from t=0 to the last time point measured. From left to right, bars represent: (1) non-coated tablet (2) tablet with 8 mg coat weight of 20:80 weight ratio of Eudragit® L30D55:Eudragit® FS30D; (3) tablet with 13 mg coat weight of 20:80 weight ratio of Eudragit® L30D55:Eudragit® FS30D; (4) tablet with 20 mg coat weight of 20:80 weight ratio of Eudragit® L30D55:Eudragit® FS30D; (5) tablet with 8 mg coat weight of 50:50 weight ratio of Eudragit® L30D55:Eudragit® FS30D; (6) tablet with 13 mg coat weight of 50:50 weight ratio of Eudragit® L30D55:Eudragit® FS30D; (7) tablet with 8 mg coat weight of 50:50 weight ratio of Eudragit® L30D55:Eudragit® FS30D; (8) Enteric-No; (9) Enteric-80m; (10) Enteric-120m; (11) Enteric 120m+HPMC60m; (12) Enteric 120m+HPMC20m.

The quantity of IL-10 delivery construct (SEQ ID NO: 5) released was calculated for tablets and capsules with different amounts of coating (FIG. 70). Related impurities (HMW aggregates, and LMW monomer) were quantified by SEC. Summation of the active (dimer) and impurities provided the total quantity of IL-10 delivery construct (SEQ ID NO: 5) related materials released from the formulation. The results obtained further indicated the performance difference between tablets and capsules with respect to IL-10 delivery construct (SEQ ID NO: 5) release.

In general, coated tablets showed comparable release of IL-10 delivery construct (SEQ ID NO: 5) dimer to non-coated tablets. The total amount of IL-10 delivery construct (SEQ ID NO: 5) related substances released from the tablets was generally close to the amount of IL-10 delivery construct in the tablet, although some loss of protein was observed at higher coating levels. In addition, the relative dimer purity of IL-10 delivery construct (SEQ ID NO: 5) dimer when considered for all material over the course of dissolution study was approximately 50% of the total released material for all tablets. Eudragit-coated capsules showed a relatively low proportion and quantity of IL-10 delivery construct (SEQ ID NO: 5) dimer release, with the majority of the protein identified as HMW aggregates. The total protein released was also reduced, presumably as a result of insoluble species formed on advanced aggregation.

The extent of inactive components such as high molecular aggregates and monomer can also be determined in this model. In tablet dissolution group shown at left side of FIG. 70, non-coated tablet was used as reference, and the coating composition varied from 50:50 (FS to L30D) to 80:20 (FS to L30D) at increased coating weight gain of 8 mg, 13 mg and 20 mg.

The improved performance of tablets relative to capsules may result from the form of the API within each formulation, the nature of the dissolution process, and/or the relative amount of Eudragit.

The coating weight on enterically-coated tablets can be significantly less than on capsules, because of the lower surface area for a given API weight (compressed tablet vs powder fill to capsule), and also the tablet surface geometry, without the joint between capsule cap and body, making it easier to achieve a uniform tablet coating for a given weight. Tablets may use a lower coat thickness. Thus, due to a smaller surface area and/or smaller thickness, the tablets may have less polymer (e.g., Eudragit) per amount of IL-10 delivery construct relative to a capsule.

Additionally, the nature of capsule dissolution may be detrimental to IL-10 delivery construct (SEQ ID NO: 5) release. Encapsulated IL-10 delivery construct may be disposed relatively loosely within in a powder from within the capsule body. Upon initial access of fluid through the dissolving capsule, a substantially (e.g., the entire) quantity of protein may be wetted. Such rapid wetting may lead to aggregation or otherwise disrupt dimer structure. In contrast, in a tablet, the IL-10 delivery construct may be blended and compressed in an insoluble matrix which is not immediately wetted throughout on initial fluid contact, but disintegrates and dissolves over a longer period of as the capsule dissolves. This may reduce the propensity towards aggregation during tablet dissolution and increase the likelihood of maintaining IL-10 delivery construct (SEQ ID NO: 5) in the active dimer form.

Example 19—Comparison of Coated Tablets Vs. Uncoated Tablets in a Type 4 Dissolution Device It was hypothesized that the lower IL-10 delivery construct (SEQ ID NO: 5) dimer purity observed on dissolution of coated tablets relative to uncoated tablets may reflect the simultaneous presence in solution of dissolved Eudragit polymers and IL-10 delivery construct (SEQ ID NO: 5), since this combination was previously shown to cause loss of IL-10 delivery construct (SEQ ID NO: 5) dimer. However, this may not reflect the in vivo situation for tablet dissolution, as the coating material may have more limited contact with IL-10 delivery construct (SEQ ID NO: 5) in the GI tract following oral administration. Instead, as the tablet moves along the gut, coating material could be gradually removed from tablet core prior to the complete release of the drug, thus separating the coating materials from the protein.

An in vitro flow through method with USP dissolution type-4 apparatus (FIG. 98) was implemented to better predict drug release in the GI tract. In comparison to the type-2 apparatus (dissolution conducted in a stirred chamber with no active flow) the type-4 instrument can operate in "open mode", whereby a constant influx of dissolution medium is delivered to maintain infinite sink conditions (i.e., no local buildup of protein or tablet components).

Coated and uncoated IL-10 delivery construct (SEQ ID NO: 5) tablets were evaluated by in vitro dissolution using the type-4 apparatus in open mode (flow-through) (FIG. 69). As expected, release of IL-10 delivery construct (SEQ ID NO: 5) was delayed as a function of increasing coating weight, but the release profile (dimer content) was not affected by coating, showing comparable initial dimer purity and degradation rate for each tablet (FIG. 69).

Coated tablets also showed delayed release, but IL-10 delivery construct (SEQ ID NO: 5) dimer content was substantially reduced compared to uncoated tablets, presumably due to the incompatibility of IL-10 delivery construct (SEQ ID NO: 5) and Eudragit polymers. It is expected that the type-4 instrument provides an environment which is more representative of the behavior of a coated IL-10 delivery construct (SEQ ID NO: 5) tablet in the GI tract and thus should better simulate in vivo performance.

Figure 98:
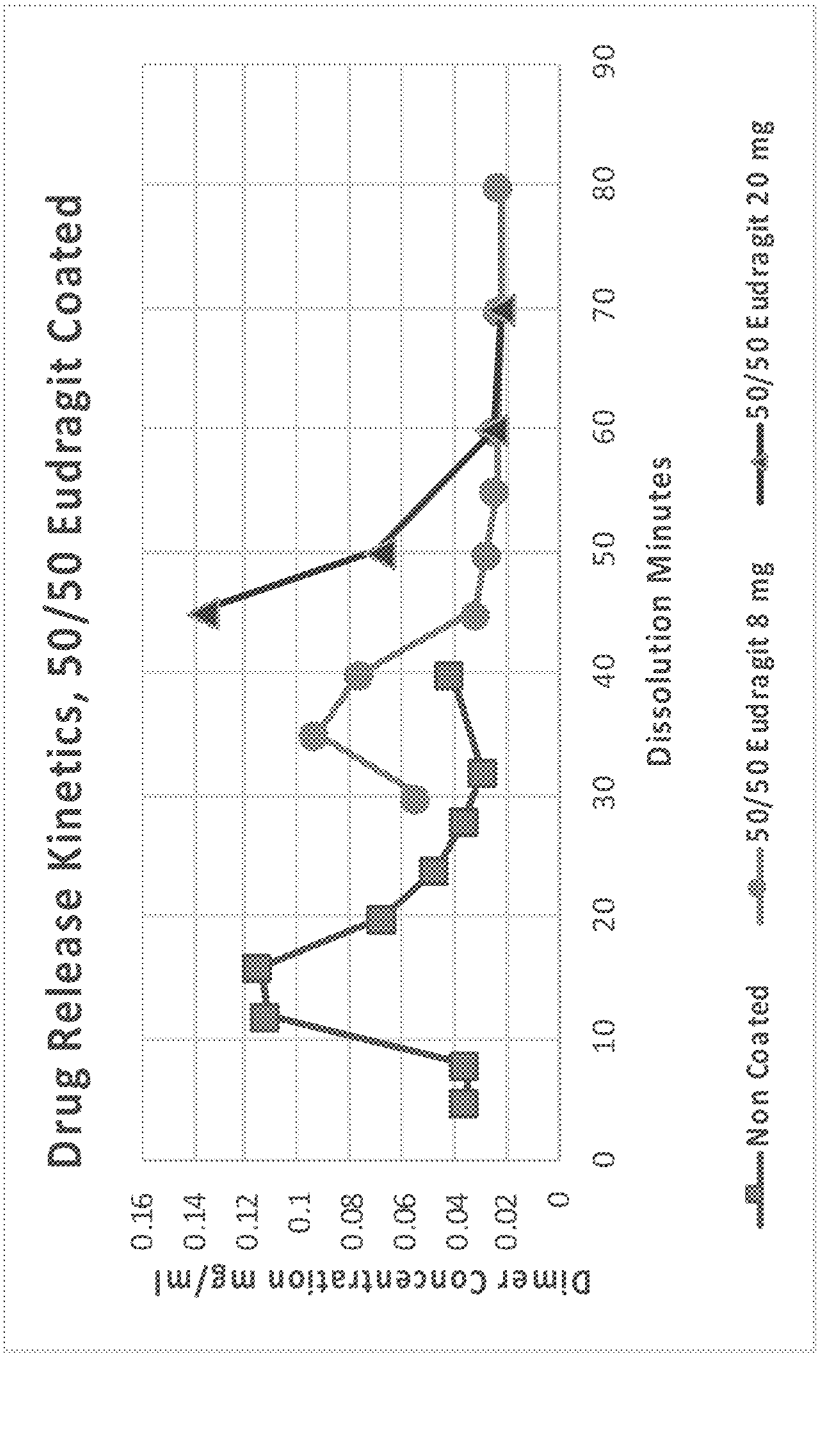
FIG. 98 illustrates IL-10 delivery construct (SEQ ID NO: 5) dimer release from Eudragit-coated tablets (50/50 L30D55/FS30D) in a Type 4 dissolution apparatus.

As well as monitoring IL-10 delivery construct (SEQ ID NO: 5) dimer purity, the quantity of drug released at each time point was obtained during type-4 dissolution (FIG. 98). Each tablet showed a similar duration of drug release, with increasing coating amounts delaying drug dissolution. These data suggested that once tablet disintegration started, the release process progressed in a similar manner, with the coated tablet core undergoing the same surface hydration and disintegration process once the coating material was removed, regardless of coating thickness. Thus the delayed release feature provided by enteric coating showed little if any impact to the drug quality in the tablet core.

Figure 99:
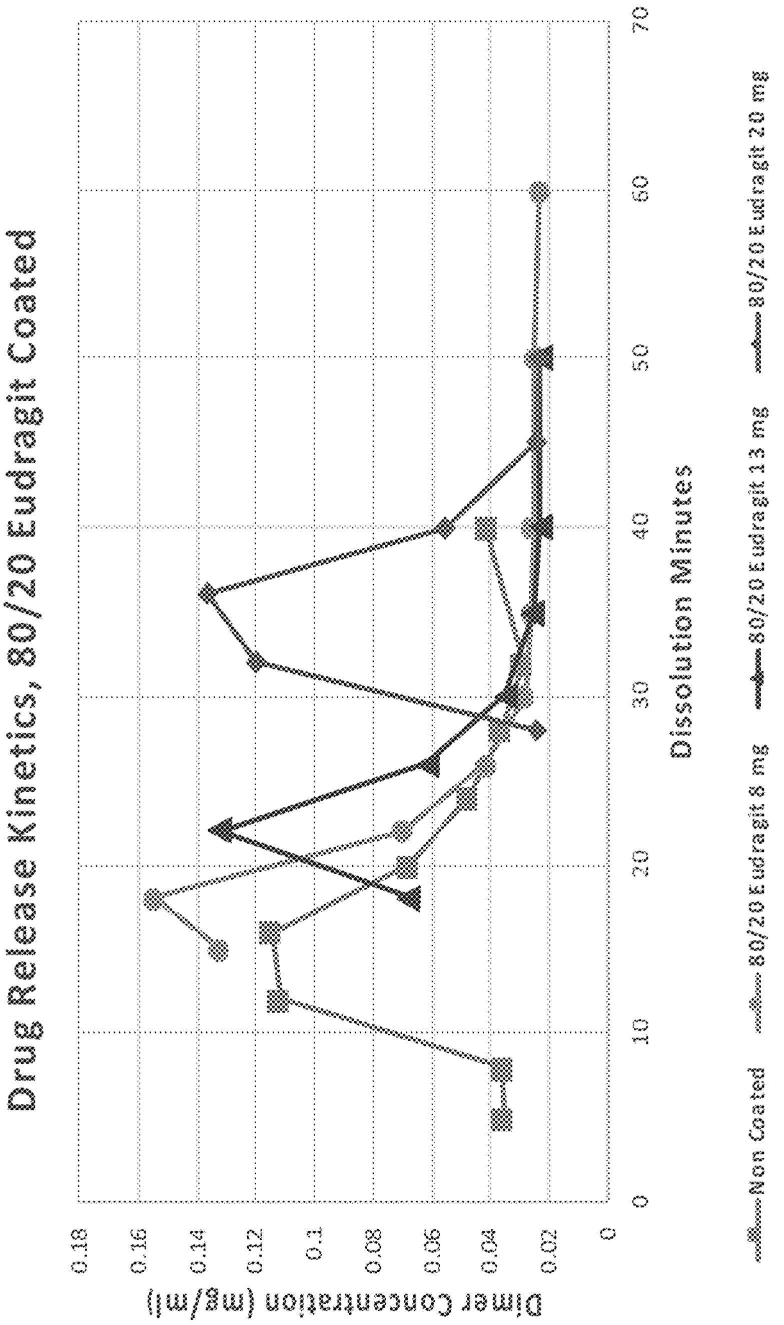
FIG. 99 illustrates IL-10 delivery construct (SEQ ID NO: 5) dimer release from Eudragit-coated tablets (20/80 L30D55/FS30D) in a Type 4 dissolution apparatus.

A second set of tablets coated with a different Eudragit formulation showed similar dissolution behavior (FIG. 99), further supporting that release of IL-10 delivery construct (SEQ ID NO: 5) was not significantly affected by the coating under these conditions in the Type 4 apparatus.

Example 20—HPMC-AS Coating of Tablets

Alternatives to Eudragit coatings were also evaluated. AQOAT® (Shin-Etsu) hypromellose acetate succinate (HPMCAS) was selected for its similar pH responsive properties, and for its weak ionic structure characteristic. These characteristics are in contrast to the strong ionic structure of Eudragits and could lead to better compatibility to IL-10 delivery construct (SEQ ID NO: 5) structural integrity during the drug tablet coating and drug release processes. A preliminary screening of compatibility was conducted. Eudragit L30D-55 and FS 30D were compared to AQOAT® products AS-HF and AS-MF, which reportedly become soluble at pH 6.8 and pH 6.0, respectively. The dimer purity of the IL-10 delivery construct (SEQ ID NO:5) incubated with various coating agents in PBS, as measured by dimer content, is shown in TABLE 47. Incubation with AS-HF and AS-MF showed little or no degradation of the IL-10 delivery construct (SEQ ID NO: 5), indicating significant improvement of drug compatibility by such HPMC-AS derivatives.

TABLE 47

Compatibility of coating materials with IL-10 delivery construct (SEQ ID NO: 5); 2 h incubation with IL-10 delivery construct (SEQ ID NO: 5) protein in PBS, structure integrity was analyzed by SEC method

| Component | Dimer | Monomer | HMW |
|---|---|---|---|
| IL-10 delivery construct (SEQ ID NO: 5) | 88.1 | 8.8 | 3.2 |
| Eudragit FS30D | 45.8 | 12.2 | 42.0 |
| Eudragit L30D55 | 12.6 | 45.2 | 42.1 |
| HPMCAS-HF | 86.2 | 11.5 | 2.3 |
| HPMCAS-MF | 88.3 | 8.7 | 3.0 |

Figure 100:
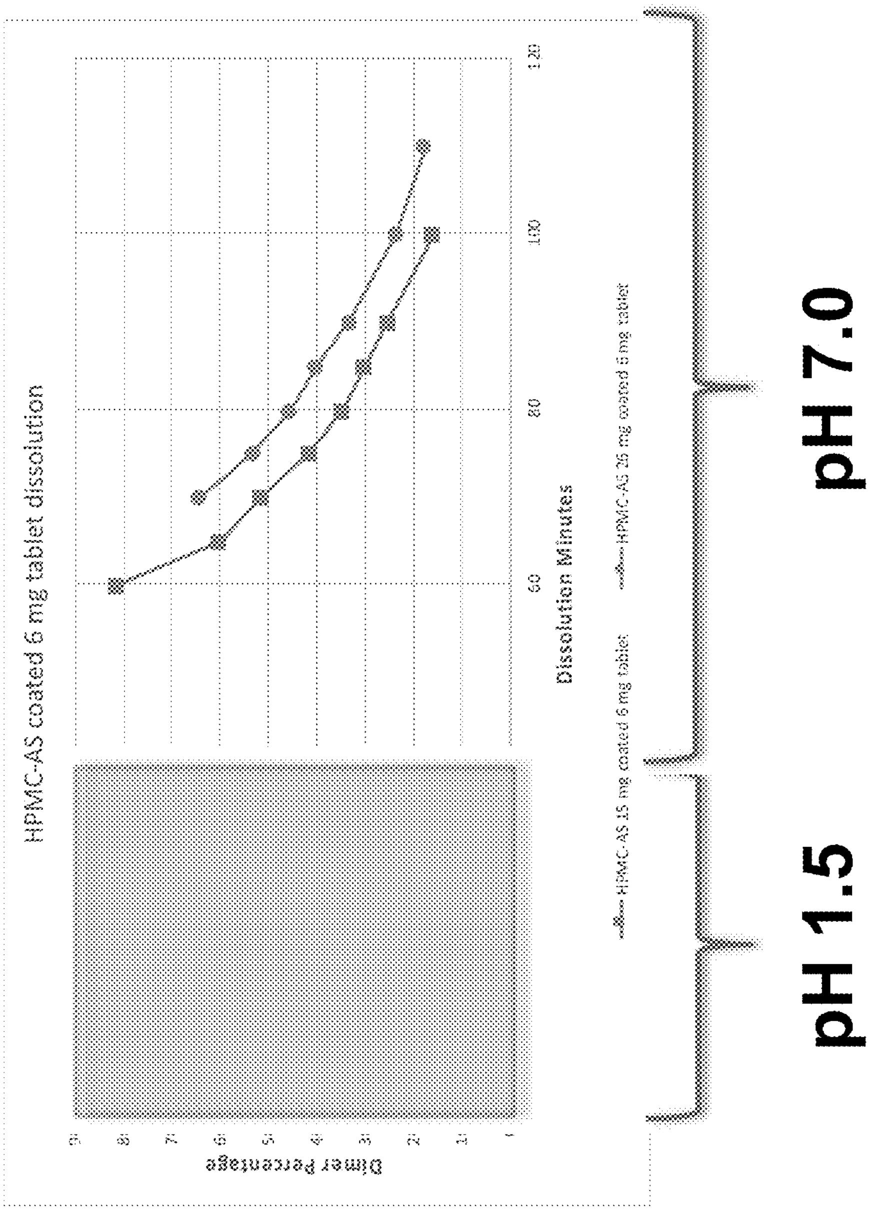
FIG. 100 illustrates dissolution of HPMC-AS coated tables (Type 4 apparatus). The dissolution started with 0.1 N HCL solution for 40 mins before the medium was switched to pH 7.0 phosphate buffer.
Figure 101:
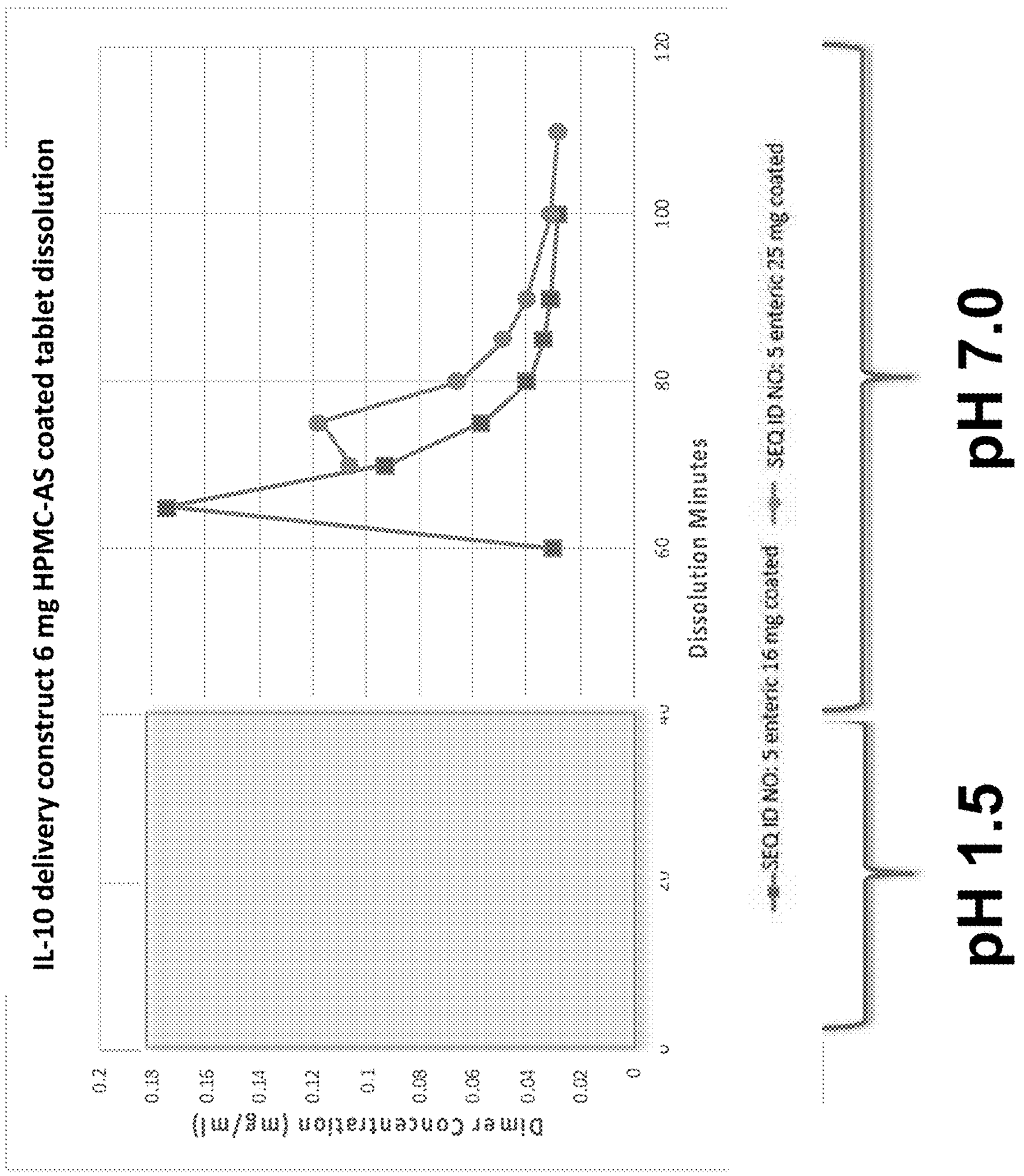
FIG. 101 illustrates IL-10 delivery construct (SEQ ID NO: 5) release from HPMC-AS coated capsules (Type 4 apparatus).

IL-10 delivery construct (SEQ ID NO: 5) tablets coated with 50:50 AS-HF and AS-MF were evaluated by dissolution on type-4 device (FIG. 100, FIG. 101). The initial dimer purity of released material was found to be essentially identical to the drug substance (lyophilized IL10 delivery construct), indicating that the HPMCAS coating has little impact on the dimer purity of the IL-10 delivery construct (SEQ ID NO: 5). The delay of release correlated with tablet coating thickness, showing comparable release rate after initial delay, and similar to that of non-coated tablets, further indicated no negative effect of the coating materials during tablet disintegration.

Figure 102:
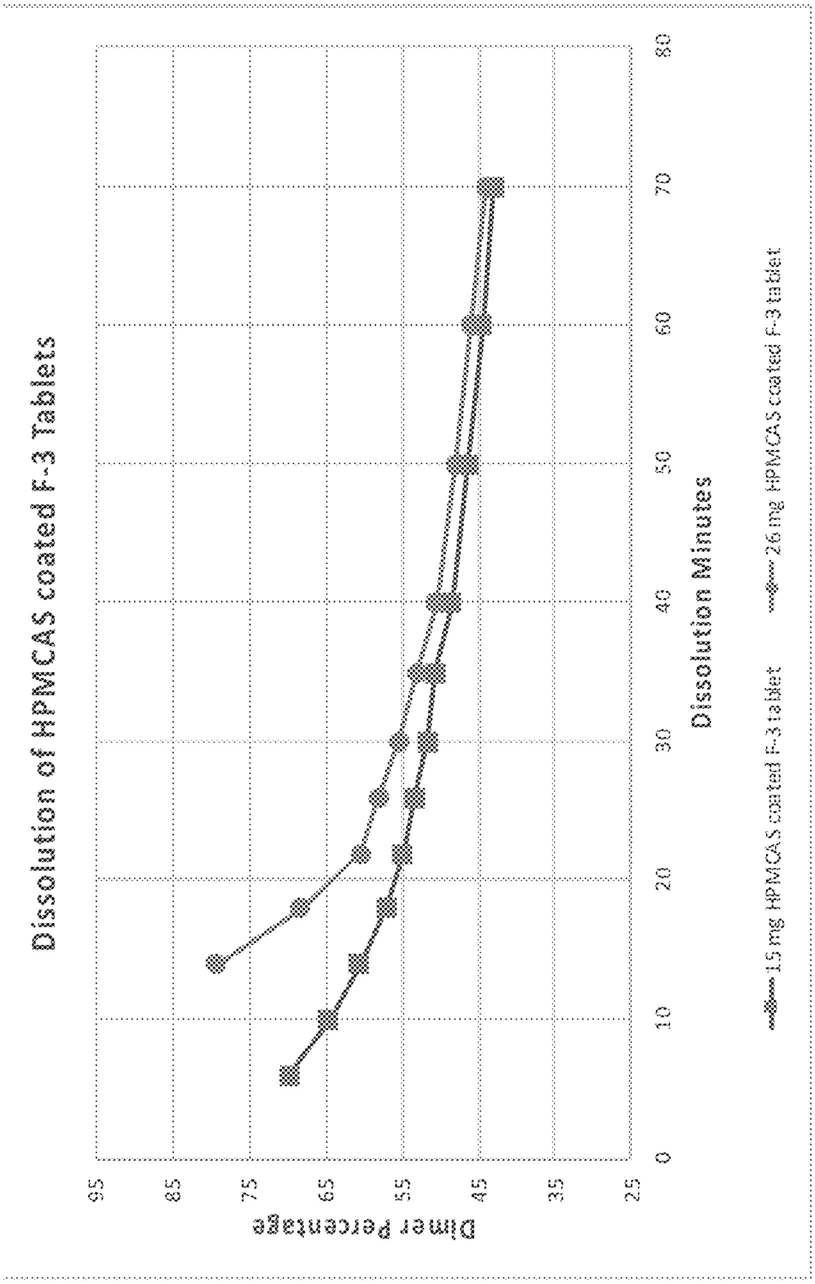
FIG. 102 illustrates dissolution of HPMC-AS coated F3 tablets on a Type 4 dissolution apparatus.
Figure 103:
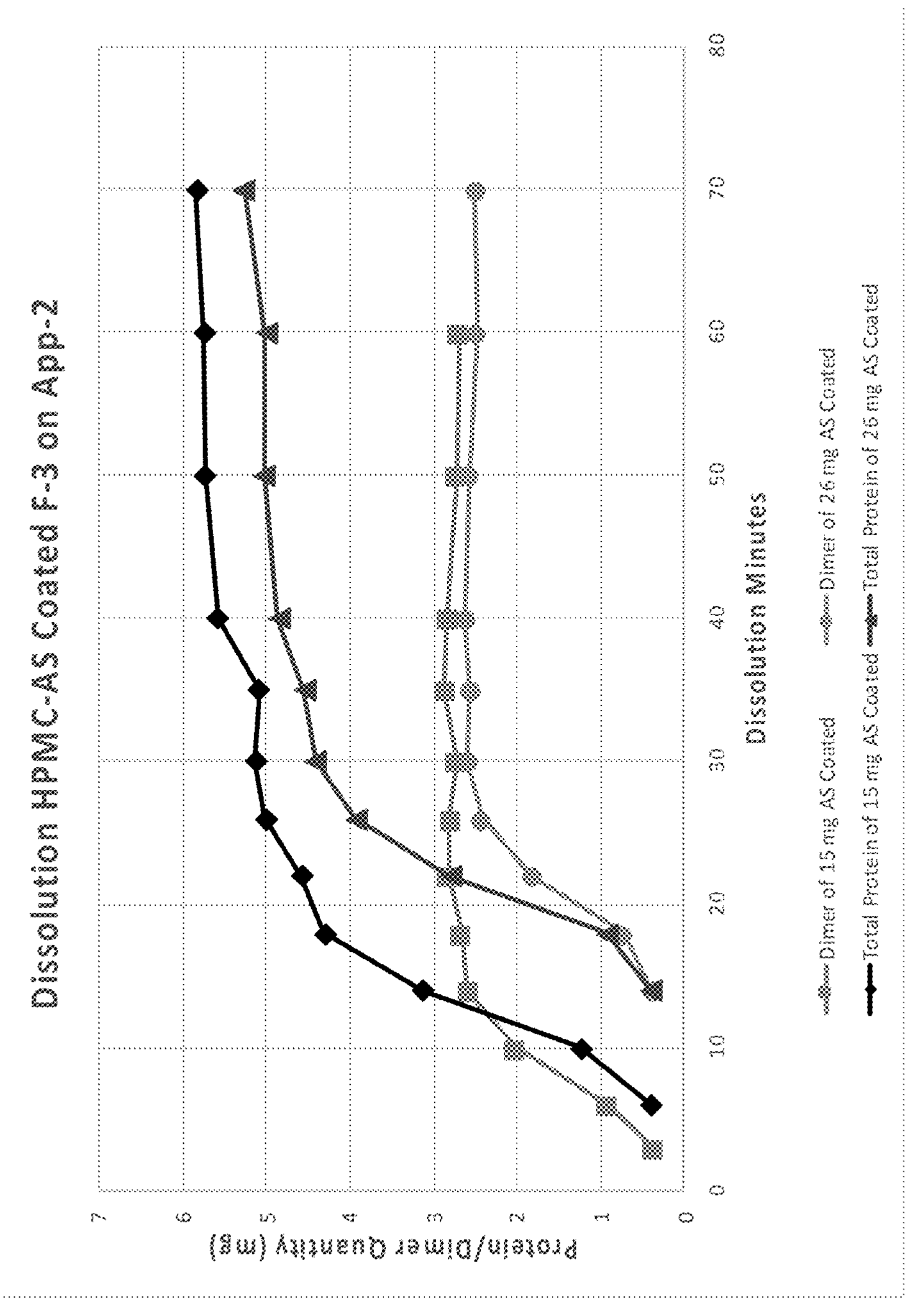

HPMC-AS coated tablets showed essentially equivalent or improved release profiles when compared to Eudragit-coated IL-10 delivery construct (SEQ ID NO: 5) tablets, as characterized by drug purity, degradation rate, and drug exposure (AUC of dimer concentration) in vitro. This was further illustrated by dissolution testing on a type-2 apparatus (FIG. 102, FIG. 103). Relative to testing in a Type-4 dissolution apparatus, the impact of incompatibility between coating and IL-10 delivery construct became more visible in such a setting. The actual in vivo release is likely to be more analogous to the conditions employed with a Type 4-dissolution apparatus. Nonetheless, in both cases, the HPMC-AS coatings displayed advantageous drug stability profiles over Eudragit coatings.

The dimer purity and concentration of IL-10 delivery construct (SEQ ID NO: 5) release were plotted against the dissolution time. On a type-2 dissolution apparatus, tablets with increased coating weight correlated with a longer delay of release. The drug concentration reached to maximum cumulative concentration in 20-30 minutes after initial disintegration, correlating to what was observed in dissolution on type-4 device that the disintegration completed in a similar time interval after the coating was initially breached.

In summary, HPMCAS coating materials demonstrated superior chemical compatibility with IL-10 delivery construct (SEQ ID NO: 5) dimer relative to Eudragits.

HPMCAS-coated IL-10 delivery construct (SEQ ID NO: 5) tablets displayed essentially equivalent or improved release profiles in terms of dimer purity and exposure in two commonly used in vitro dissolution models. The two stage dissolution on flow through model confirmed that the coating was pH responsive as it was stable at lower pH and becoming labile at high pH for drug release. The HPMCAS coating provided protection of the IL-10 delivery construct at a low pH was found effect The drug protection by coating at low pH was found effective as the drug exposure in dissolution test remained same with or without acid treatment.

Example 21—Assessment of Pharmacokinetics and Pharmacodynamics of an IL-10 Delivery Construct (SEQ ID NO: 5) Through Pan-Colonic Administration Via Sigmoidoscopy in Non-Human Primates This non-GLP study was conducted to investigate PK and PD in male cynomolgus monkeys (n=3/group) administered a single dose of 1, 3 or 10 mg IL-10 delivery construct (SEQ ID NO: 5) through pan-colonic administration via sigmoidoscopy. IL-10 delivery construct solution (at concentrations of 0.1, 0.3 and 1.0 mg/mL for the low, mid and high-dose groups respectively) was administered via the rectal route using sigmoidoscopy and a syringe connected to a spray nozzle with a 360° spray pattern. Serial biopsy samples were collected by sigmoidoscopy (pre-dose, 0.25, 0.5, 0.75, 8 and 24-28 hours post dose). Serial plasma samples from 0 min pre-dose to between 24-28 hours post-dose were collected for analysis for the IL-10 delivery construct.

Plasma Concentration of Total IL-10 and IL-10 Delivery Construct (SEQ ID NO: 5)

Figure 71A:
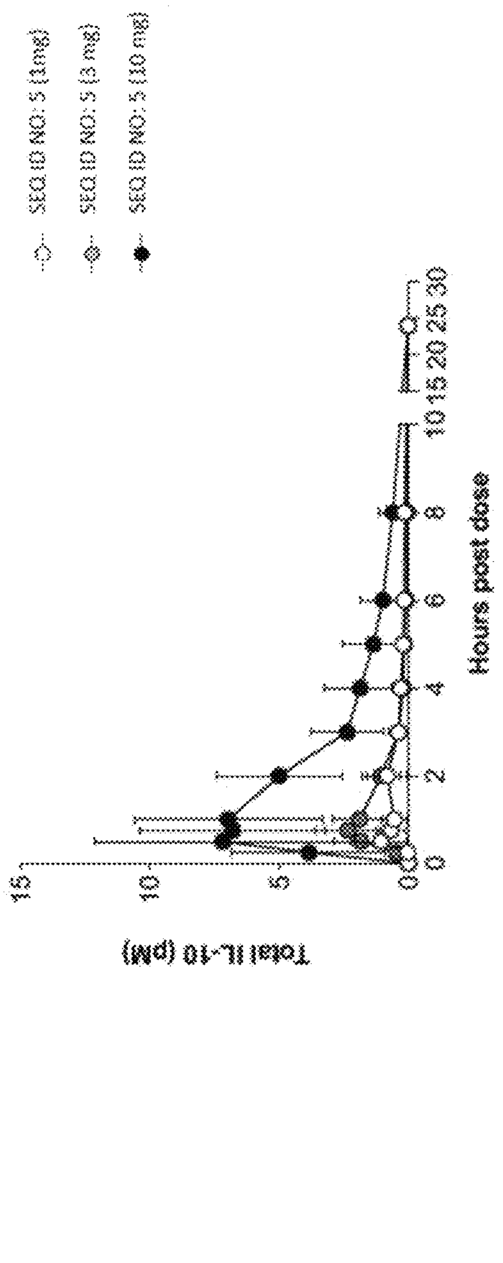
FIGS. 71A-71C illustrate systemic concentrations of certain markers measured over 24 hours by immunoassay, following pan-colonic administration of IL-10 delivery construct (SEQ ID NO: 5) at 1, 3, and 10 mg (n=3/group). Data are expressed as mean SEM, statistical analysis not performed.
Figure 71B:
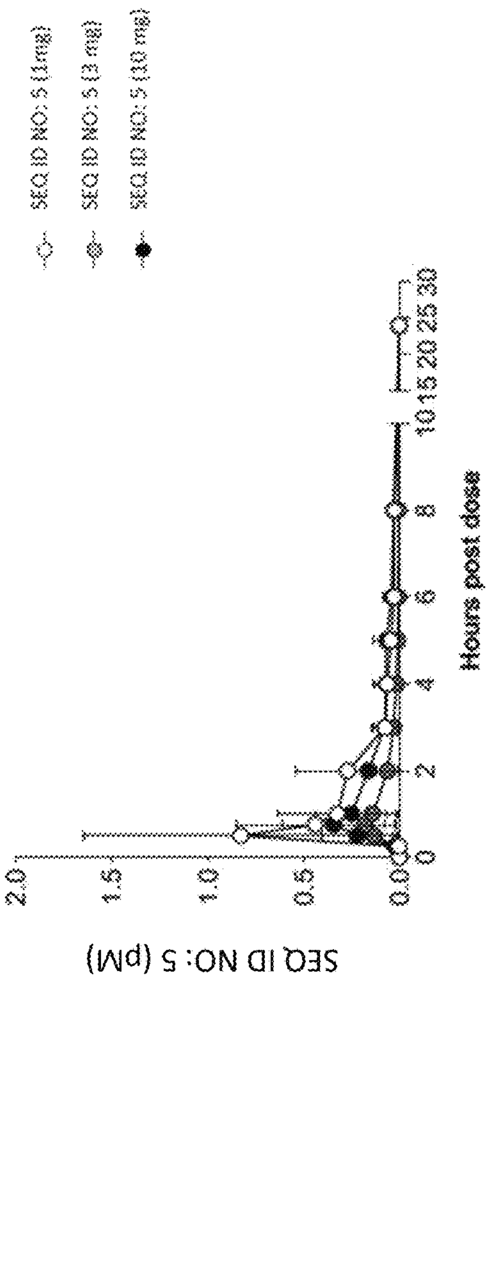

Exposure, determined by total IL-10 concentration, resulting from a single dose of IL-10 delivery construct (SEQ ID NO: 5) delivered directly to the colon via sigmoidoscope was detected in the plasma within 15 minutes of administration (FIG. 71A). Exposure to total IL-10 increased with dose and $t_{max}$ occurred within one hour of delivery in all three dose groups (1, 3, and 10 mg) (FIG. 71A). In addition to total IL-10 analysis, IL-10 delivery construct (SEQ ID NO: 5) concentration was determined by an anti-cholix[386] capture antibody, in conjunction with an anti-human IL-10 detection antibody. IL-10 delivery construct (SEQ ID NO: 5) concentration (FIG. 71B) were 10-fold lower than those of IL-10 at 3 mg and 10 mg doses (FIG. 71A). A dose-dependent response in IL-10 delivery construct (SEQ ID NO: 5) was not revealed between the groups. The lower plasma IL-10 delivery construct (SEQ ID NO: 5) concentrations, compared to total IL-10, imply that circulating IL-10 delivery construct (SEQ ID NO: 5) may be comprised of cleaved or otherwise processed versions of IL-10 delivery construct (SEQ ID NO: 5), in which the cholix[386] domain (SEQ ID NO: 4) was no longer conjugated to rhIL-10.

Figure 71C:
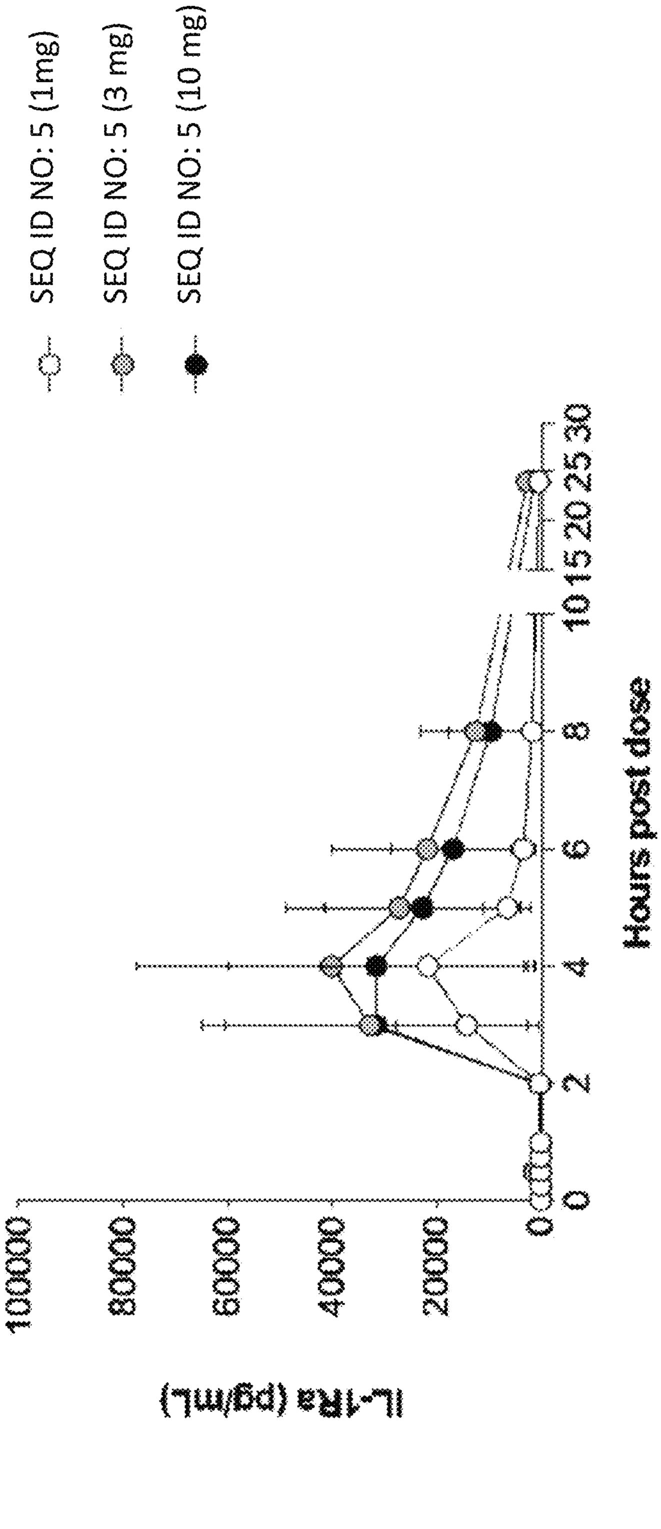

Plasma Concentration of IL-1Ra Following IL-10 Delivery Construct (SEQ ID NO: 5) Administration An induction of the plasma concentration of IL-1Ra was observed at all three doses (1, 3 and 10 mg). IL-1Ra was detected at higher concentrations in response to the 3 and 10 mg doses, compared to 1 mg (FIG. 71C); however high intra-group variability was detected and a clear dose-dependent response was not observed. The absence of a dose-dependent effect at the higher concentrations of IL-10 delivery construct (SEQ ID NO: 5) suggested that the IL-10 induction of IL-1Ra was saturated at the 10 mg dose. Total IL-10 peaked at approximately 0.5-1 h (FIG. 71A), and maximal plasma IL-1Ra concentration followed at 3-4 h (FIG. 71C). Despite considerable variations in exposure and IL-1Ra production between animals, the relative kinetics of total IL-10 and IL-1Ra detection suggested that IL-1Ra induction may be mediated by IL-10 delivery construct (SEQ ID NO: 5).

Figure 72:
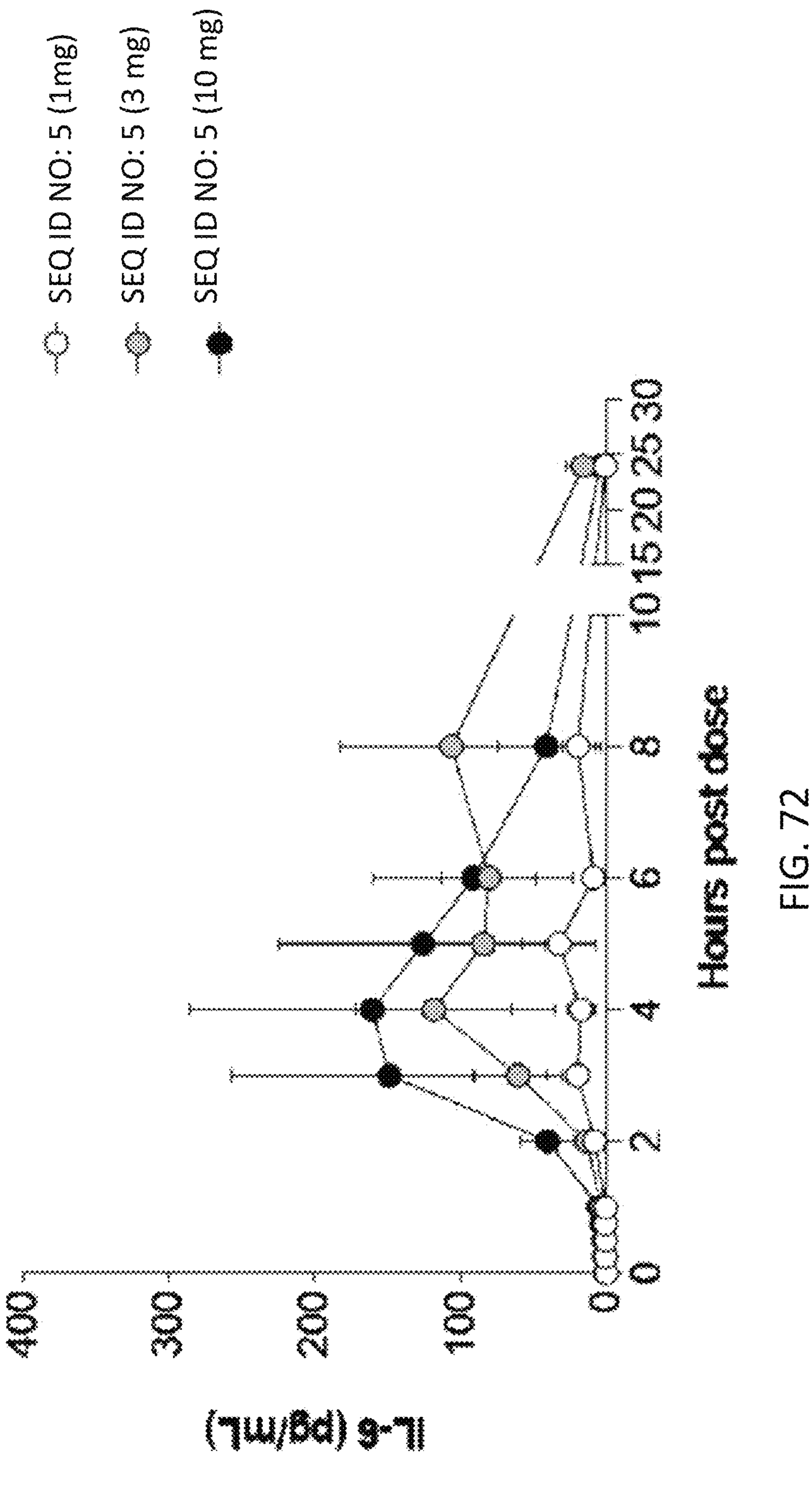
FIG. 72 illustrates systemic concentration of IL-6 measured over 24 hours by immunoassay, following pan-colonic administration of IL-10 delivery construct (SEQ ID NO: 5) at 1, 3, and 10 mg (n=3/group). Data are expressed as mean SEM, statistical analysis not performed.

Plasma Concentration of Pro-Inflammatory Cytokines Following IL-10 Delivery Construct (SEQ ID NO: 5) Administration Colonic administration of IL-10 delivery construct (SEQ ID NO: 5) did not lead to an increase in the systemic concentrations of pro-inflammatory cytokines IFN-γ, IL-1β, IL-2 or IL-8, but IL-6 was moderately induced in the 3 and 10 mg groups (FIG. 72).

Exposure, assessed by total IL-10 concentration, from a single dose of IL-10 delivery construct (SEQ ID NO: 5) delivered directly to the colon via sigmoidoscope was detected in the colonic tissue (FIG. 105C) and systemic circulation (FIG. 105A). Exposure was also assessed by IL-1Ra concentration in systemic circulation (FIG. 105B). A dose-dependent increase in total IL-10 was detected in the tissue, which peaked at the first sampling time point of 15 minutes. In addition to total IL-10 analysis, the concentration of IL-10 delivery construct (SEQ ID NO: 5) in colonic tissue was determined. Tissue IL-10 delivery construct (SEQ ID NO: 5) concentrations did not reveal clear dose dependence among the groups (FIG. 105D). IL-10 delivery construct (SEQ ID NO: 5) concentration was increased 15 minutes following the 1 and 10 mg doses, with high variability detected within the groups.

Figure 73:
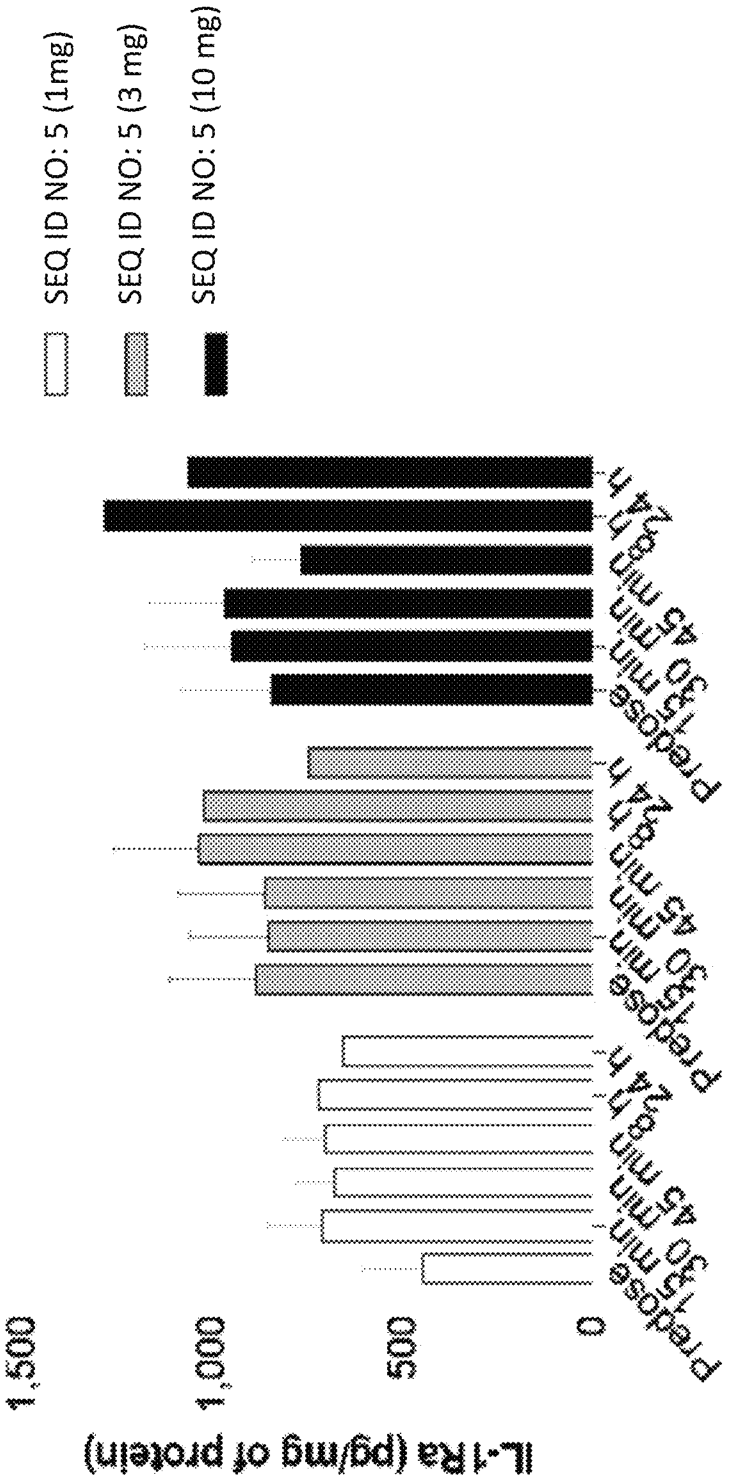
FIG. 73 illustrates concentration of IL-1Ra measured over 24 h by immunoassay, following pan-colonic administration of IL-10 delivery construct (SEQ ID NO: 5) at 1, 3 and 10 mg. Data are expressed as mean SEM; n per IL-10 delivery construct dose: predose (2), 15 min (3), 30 min (3), 45 min (3), 8 h (1) and 24 h (1); statistical analysis not performed.

IL-1Ra Concentration in Colonic Tissue Following Pan-Colonic IL-10 Delivery Construct (SEQ ID NO: 5) Administration IL-1Ra concentration was assessed in the colonic tissue of NHP following pan-colonic delivery at IL-10 delivery construct (SEQ ID NO: 5) at 1, 3, and 10 mg doses. High concentrations of endogenous IL-1Ra were detected in colon tissue lysates at baseline and IL-1Ra concentration was not further augmented in response to the IL-10 delivery construct (FIG. 73).

Figure 74:
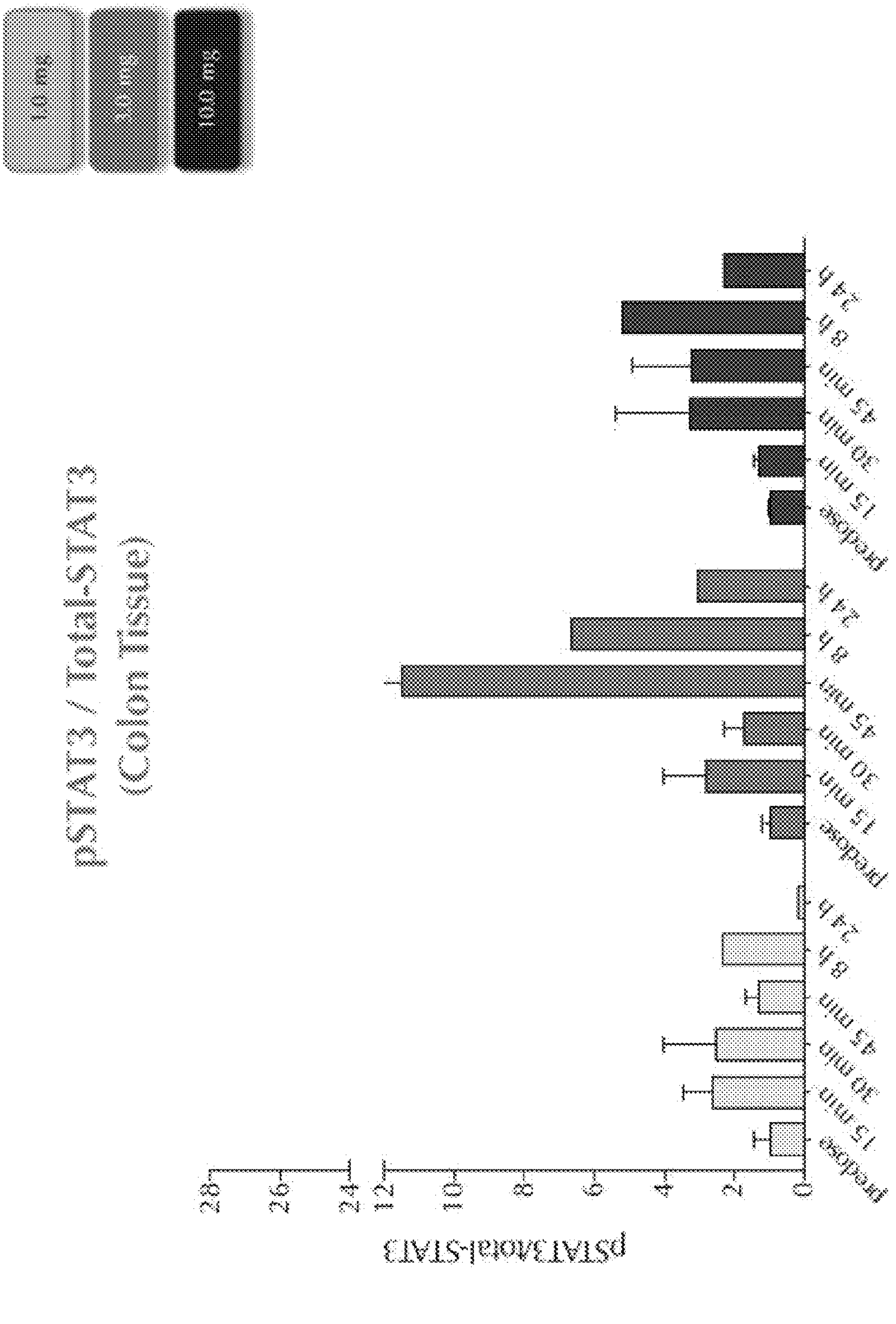
FIG. 74 illustrates STAT3 phosphorylation in colonic tissue, as measured by the ratio of pSTAT3 to total STAT3. Phosphorylation and total expression were measured by immunoassay over 45 min, following pan-colonic administration of IL-10 delivery construct (SEQ ID NO: 5) at 1, 3 and 10 mg. Data are expressed as mean SEM, n per IL-10 delivery construct dose: predose (2), 15 min (3), 30 min (3) and 45 min (3), statistical analysis not performed.

Phosphorylation of STAT3 in Tissue Following Pan-Colonic IL-10 Delivery Construct (SEQ ID NO: 5) Administration Phosphorylation of STAT3 is an early downstream event following IL-10 receptor activation. STAT3 phosphorylation was investigated in colonic tissue samples from several time points (15, 30, and 45 minutes, 8 hours, and 24 hours) following IL-10 delivery construct (SEQ ID NO: 5) administration. Higher ratios of colonic tissue pSTAT3/STAT3, indicative of colonic STAT3 activation, were observed following IL-10 delivery construct treatment at all doses tested (FIG. 74).

Analysis of Pro-Inflammatory Cytokine Concentrations in Colonic Tissue Lysates Following Pan-Colonic Administration of IL-10 Delivery Construct (SEQ ID NO: 5)

Figure 75:
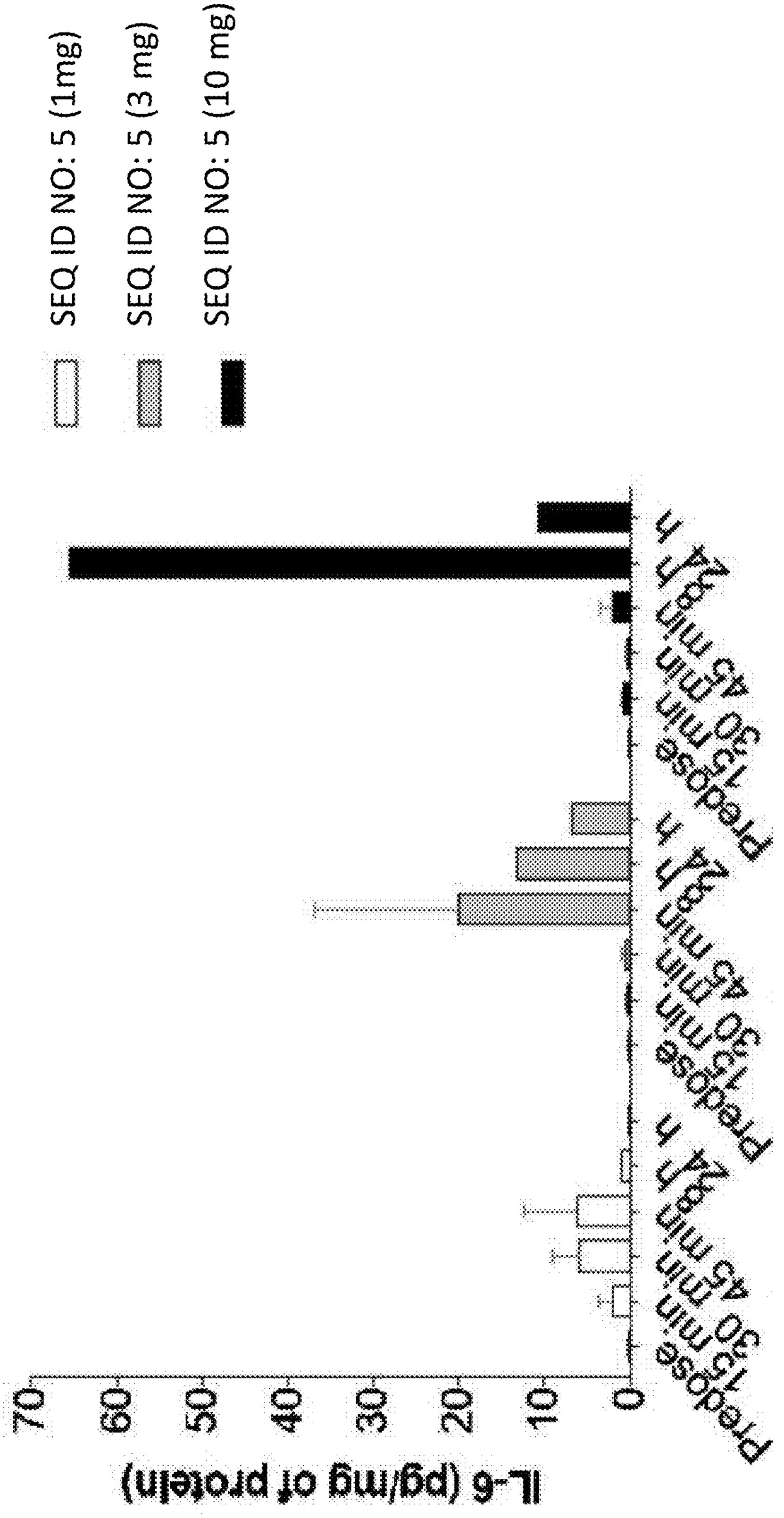
FIG. 75 illustrates tissue concentration of IL-6 measured over 24 h by immunoassay, following pan-colonic administration of IL-10 delivery construct (SEQ ID NO: 5) at 1, 3 and 10 mg. Data are expressed as mean SEM; n per IL-10 delivery construct dose: predose (2), 15 min (3), 30 min (3), 45 min (3), 8 h (1) and 24 h (1); statistical analysis not performed.

Induction of pro-inflammatory cytokines in colonic tissue was not observed; however, there was evidence for an increase in plasma concentrations of IL-6 with IL-10 delivery construct treatment (FIG. 75).

Figure 76:
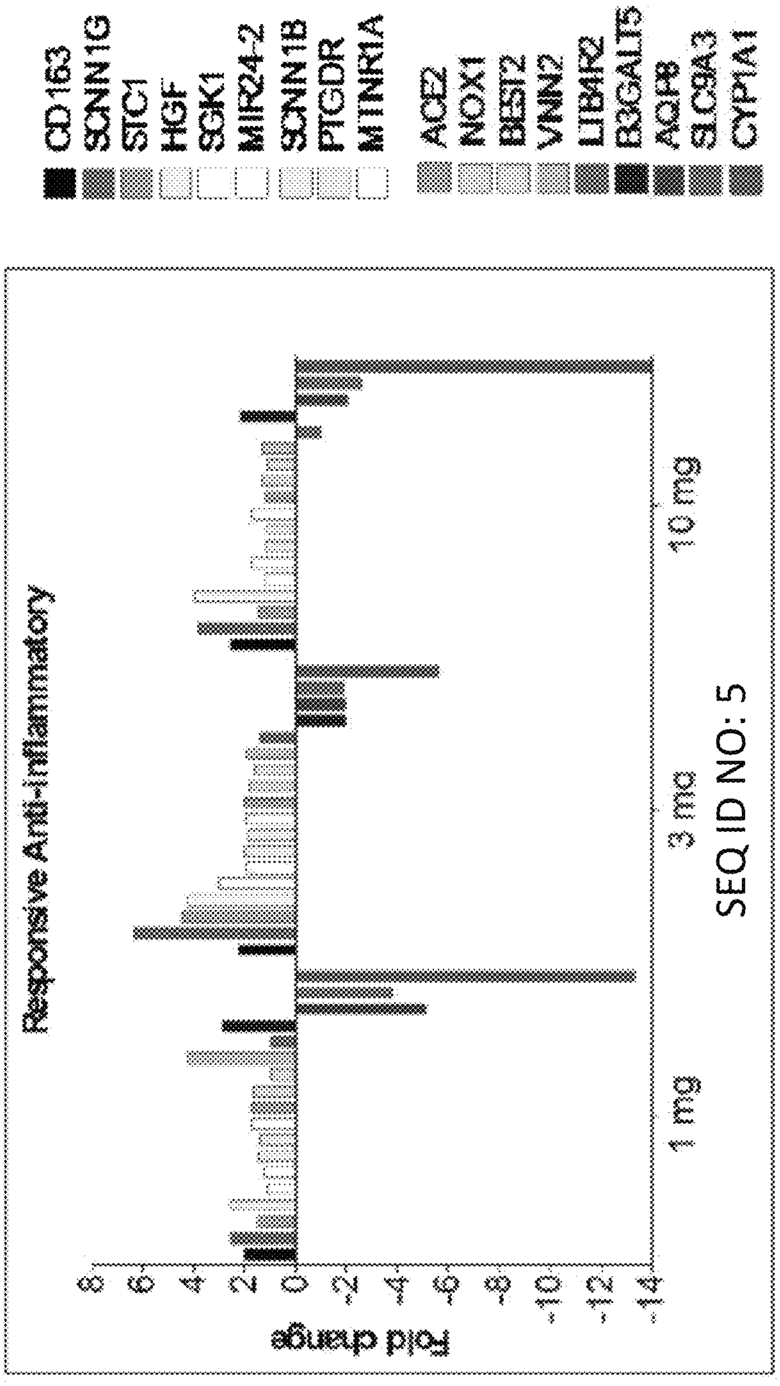
FIG. 76 illustrates the regulation of colonic anti-inflammatory genes assessed at 8 h following pan-colonic administration of IL-10 delivery construct (SEQ ID NO: 5) at 1, 3, and 10 mg doses; n per group: predose (4), all doses of IL-10 delivery construct (2). Data are expressed as mean; statistical analysis not performed. For each dose, bars from left to right illustrate fold change observed for: CD163, SCNN1G, STC1, HGF, SGK1, MIR24-2, SCNN1B, PTGDR, MTNR1A, ACE2, NOX1, BEST2, VNN2, LTB4R2, B3GALT5, AQP8, SLC9A3, and CYP1A1.
Figure 77:
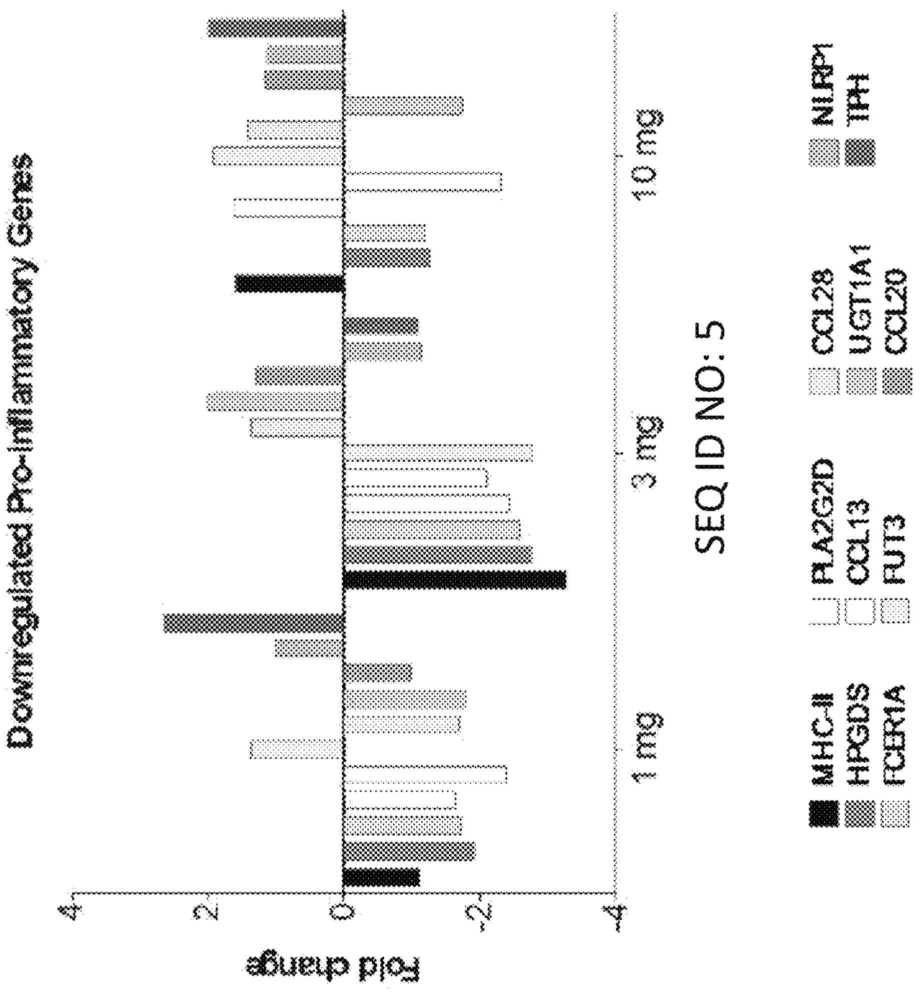
FIG. 77 illustrates regulation of colonic pro-inflammatory genes assessed at 8 h following pan-colonic administration of IL-10 delivery construct (SEQ ID NO: 5) at 1, 3, and 10 mg doses; n per group: predose (4), all doses of IL-10 delivery construct (2). Data are expressed as mean; statistical analysis not performed. For each dose, bars from left to right illustrate: MHC-II, HPGDS, FCER1A, PLA2G2D, CCL13, FUT3, CCL28, UGT1A1, CCL20, NLRP1, and TPH.
Figure 78:
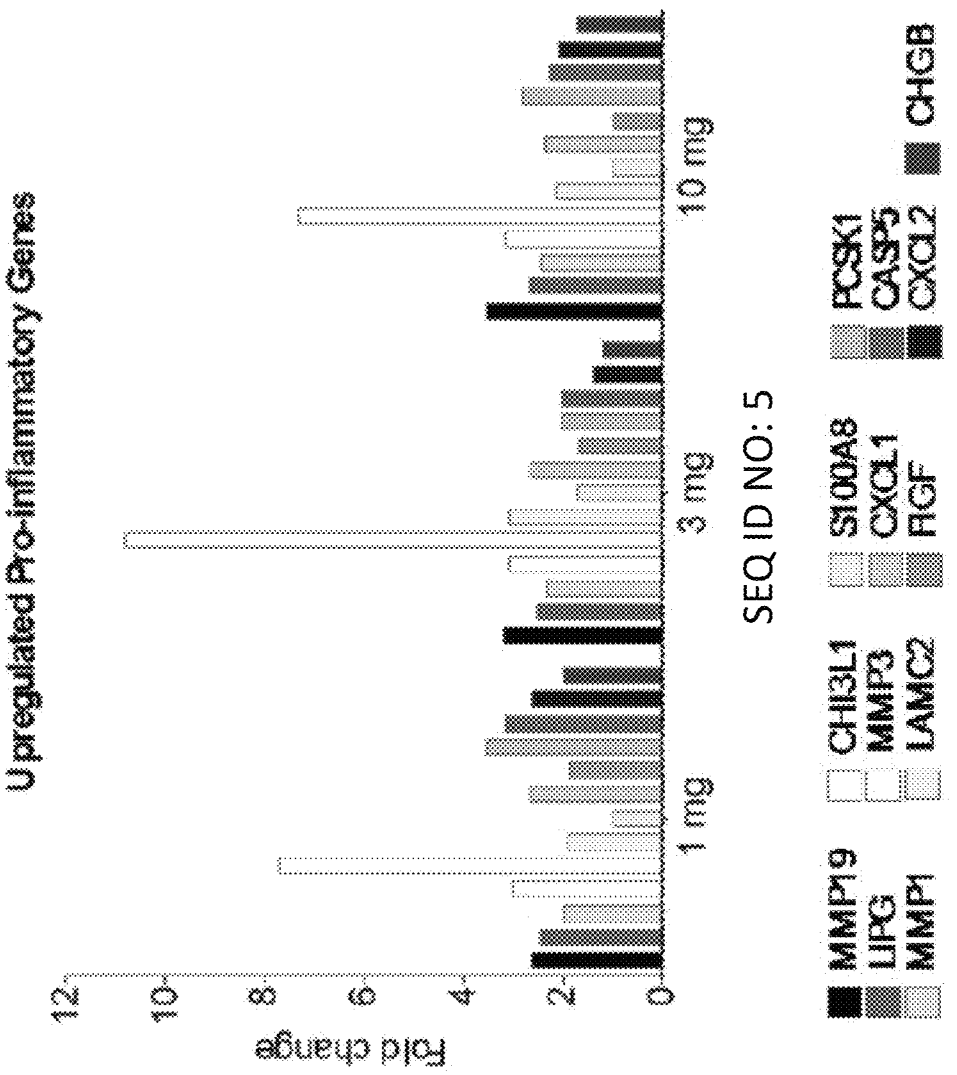
FIG. 78 illustrates regulation of colonic pro-inflammatory genes assessed at 8 h following pan-colonic administration of IL-10 delivery construct (SEQ ID NO: 5) at 1, 3, and 10 mg doses; n per group: predose (4), all doses of IL-10 delivery construct (2). Data are expressed as mean of 2-3 probes per target; statistical analysis not performed. For each dose, bars from left to right illustrate: MMP19, LIPG, MMP1, CHI3L1, MMP3, LAMC2, S100A8, CXCL1, FIGF, PCSK1, CASP5, CXCL2, and CHGB.
Figure 79:
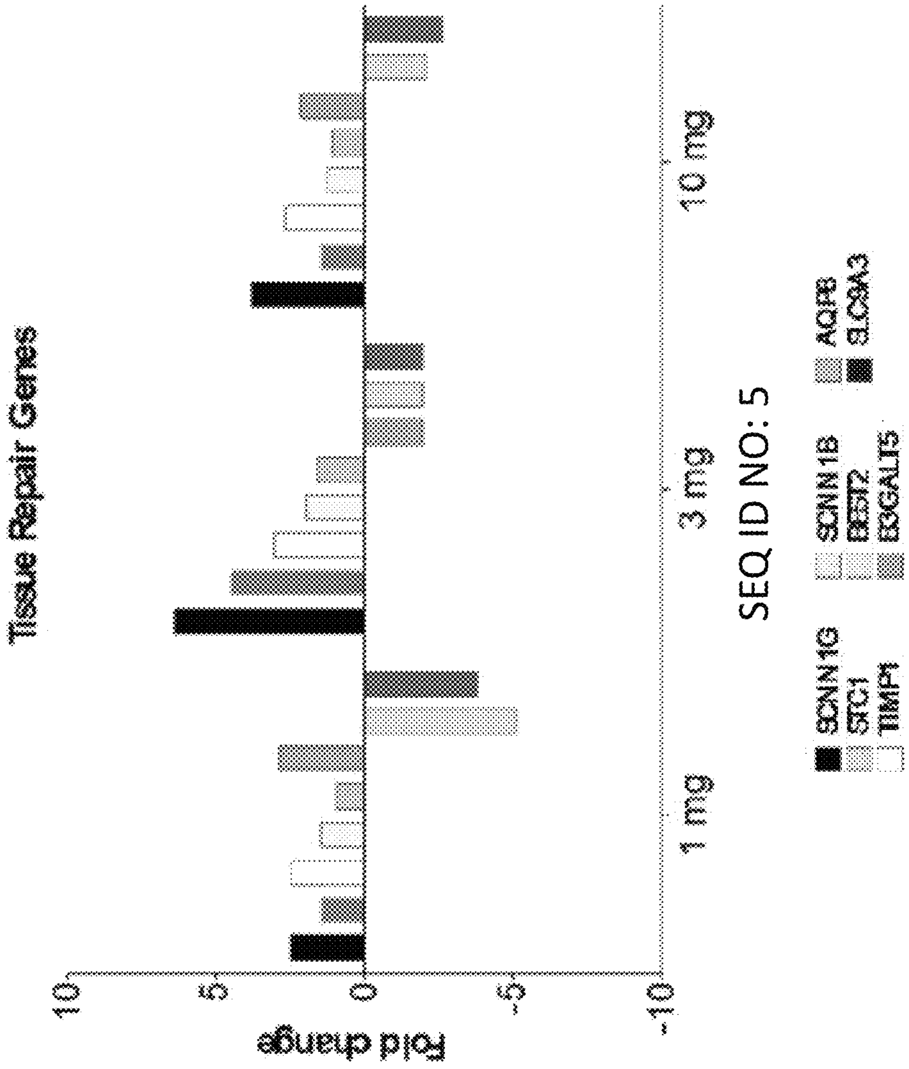
FIG. 79 illustrates regulation of colonic tissue repair genes assessed at 8 h following pan-colonic administration of IL-10 delivery construct (SEQ ID NO: 5) at 1, 3, and 10 mg doses; n per group: predose (4), all doses of IL-10 delivery construct (2). Data are expressed as mean; statistical analysis not performed. For each dose, bars from left to right illustrate: SCNN1G, STC1, TIMP1, SCNN1B, BEST2, B3GALT5, AQP8, and SLC9A3.
Figure 80:
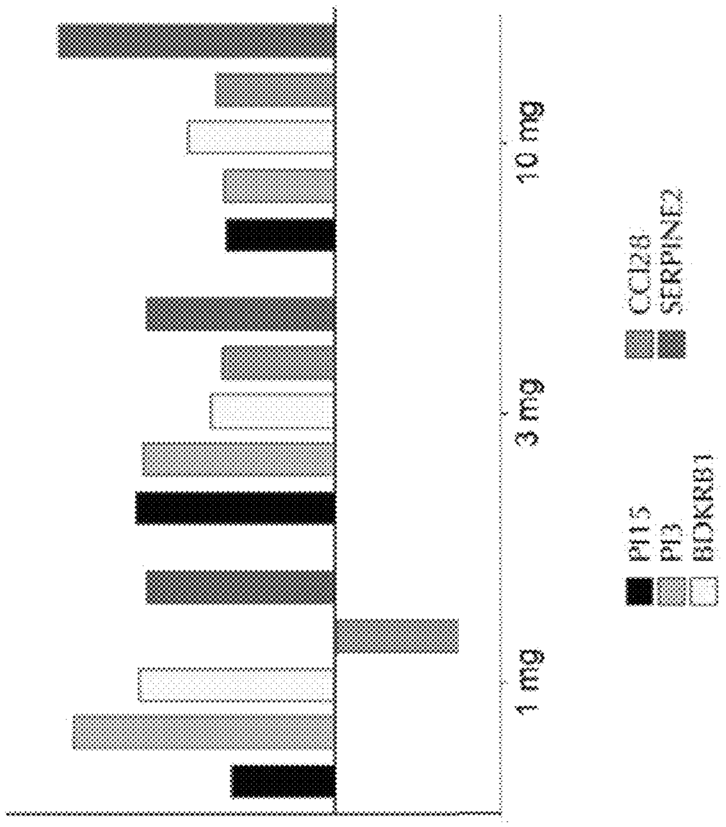
FIG. 80 illustrates regulation of colonic anti-microbial genes assessed at 8 h following pan-colonic administration of IL-10 delivery construct (SEQ ID NO: 5) at 1, 3, and 10 mg doses; n per group: predose (4), all doses of IL-10 delivery construct (2). Data are expressed as mean; statistical analysis not performed. For each dose, bars from left to right illustrate: PI15, PI3, BDKRB1, CCI28, and SERPINE2.

Colonic biopsies at each tissue timepoint were analyzed for local concentration of IL-10 delivery construct, total IL-10, IL-1Ra, soluble cytokines, activation of STAT3 and gene expression following administration of the IL-10 delivery construct. The IL-10 delivery construct treatment upregulated a number of anti-inflammatory genes, notably including CD163, miR24-2 and NOX1, which play roles in the differentiation or function of tolerogenic M2 macrophages. In addition, STC1, MTNR1A and VNN2 encode proteins that suppress the NFkβ signaling pathway, a pathway through which key pro-inflammatory cytokines are regulated. The IL-10 delivery construct treatment downregulated the expression of the drug metabolizing enzyme CYP1A1; however, the 12-hour fast prior to treatment could have influenced CYP1A1 expression (FIG. 76). IL-10 delivery construct administration decreased a number of pro-inflammatory genes including MHCII and PLA2G2D, which are expressed by dendritic cells and macrophages. This is consistent with the ability of IL-10 to suppress these cells' activation or differentiation towards a pro-inflammatory immune phenotype. In addition, the IL-10 delivery construct downregulated CCL20 and CCL13, chemoattractants that recruit macrophages and innate immune cells, respectively (FIG. 77). With IL-10 delivery construct treatment, a number of pro-inflammatory genes were also upregulated, including matrix metalloproteinases: MMP1, MMP3 and MMP19 (FIG. 78). Importantly, consistent with the regulatory function of IL-10, the IL-10 delivery construct also increased a matrix metalloproteinases inhibitor, TIMP1, as well as other tissue repair (FIG. 79) and antimicrobial genes (FIG. 80).

Example 22—Assessment of Effects of an IL-10 Delivery Construct (SEQ ID NO: 5) in a Mouse Model of Ulcerative Colitis This study was conducted to investigate the efficacy of oral treatment with an IL-10 delivery construct (SEQ ID NO: 5) in a murine oxazolone-induced ulcerative colitis model. Oxazolone-induced colitis in mice constitutes an animal model of UC with similarity to the histopathological characteristics and distribution of inflammation described in human ulcerative colitis and can be used to screen potential therapeutic agents.

Healthy young female SJL/J mice were pre-sensitized with 200 μl of 3% (w/v) solution of oxazolone (4-ethoxymethylene-2-phenyl-2-oxazoline-5-one) in 100% ethanol, applied topically. Five days after pre-sensitization, mice were challenged intra-rectally with 150 μL of 1% oxazolone in 40% ethanol. Control mice were pre-sensitized with 100% ethanol on day −5 followed by intra-rectal administration of 150 μL of 40% ethanol (no oxazolone). Mice were dosed by oral gavage once a day (q.d.) with the IL-10 delivery construct, 5-ASA (100 mg/kg, 15 mice) or Vehicle from day −5 to day +6 for a total of 12 doses. The IL-10 delivery construct was provided at four different doses: 9 mg/kg, 3 mk/kg, 1 mg/kg, and 0.3 mg/kg. There were 15 mice in each treatment group, 10 mice in the vehicle treated group, and 5 mice in the naïve control group.

Blood samples were collected into microtainer tubes (BD 365974) containing EDTA and centrifuged at 500 RCF at room temperature (RT) for 10 minutes. Supernatants were collected and transferred into a clean tube and re-centrifuged at 13,000 RCF RT for 10 minutes. Plasma samples were aliquoted into two 80-100 μL size aliquots and stored at −80° C. Jejunum and ileum from each surviving mouse were removed and cleared of all fecal content with cold PBS and approximately 1 cm of each section was flash-frozen. The colon (minus cecum) from each of the surviving mice was removed and cleared of all fecal matter with cold PBS. Colon length and weight were recorded. Samples were cut from the colon at different points along the length of the colon (region 1 proximal, region 2 mid, region 3 between regions 2 and 4, and region 4 distal) and preserved in 10% neutral formalin buffer for 24 hrs. and then transferred to 70% EtOH. These samples were sectioned and stained by hematoxylin and eosin staining or immune fluorescence. Region 3 of the same colons was flash-frozen.

Figure 81A:
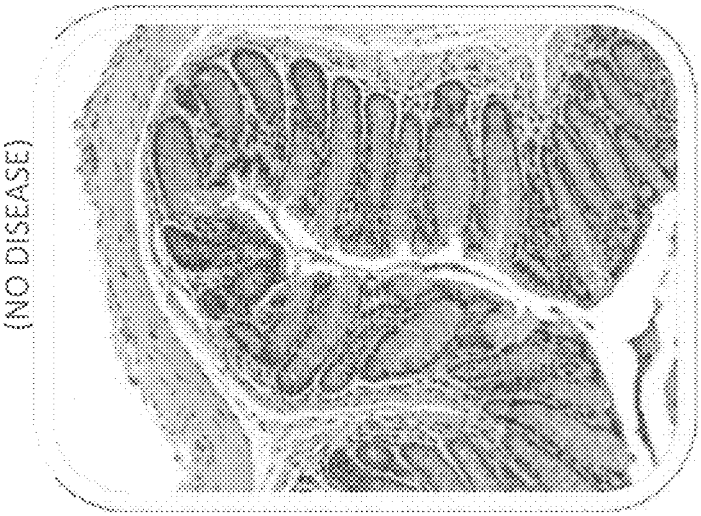
FIGS. 81A-81C illustrate hematoxylin and eosin staining of sections of mouse colon.
Figure 81B:
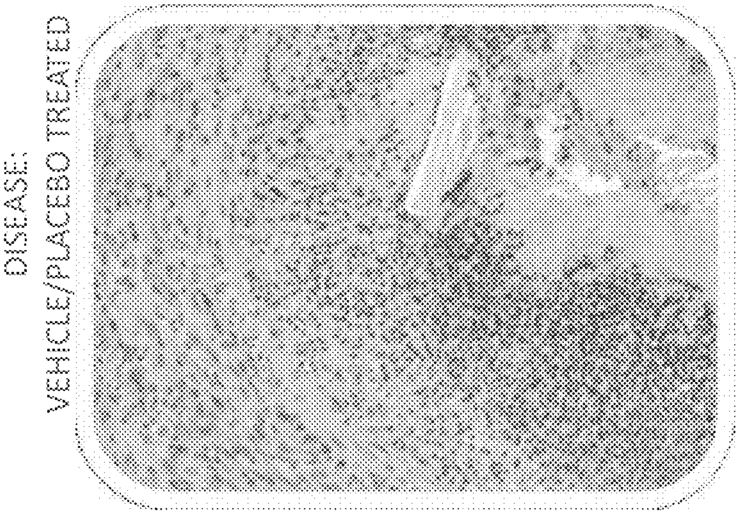
Figure 81C:
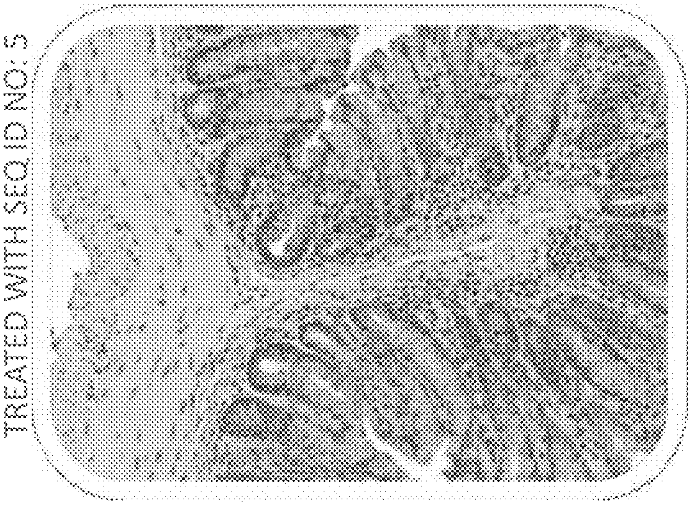

Treatment with the IL-10 delivery construct (SEQ ID NO: 5) resulted in improved colonic histopathology. FIG. 81A shows hematoxylin and eosin staining of a naïve colon, while FIG. 81B shows a colon section from a mouse which was treated with oxazolone to induce a disease state, but received vehicle in the treatment phase. The colonic histopathology is improved in FIG. 81C which shows a section from a representative oxazolone induced mouse treated with an IL-10 delivery construct (8.5 mg/kg).

Figure 82B:
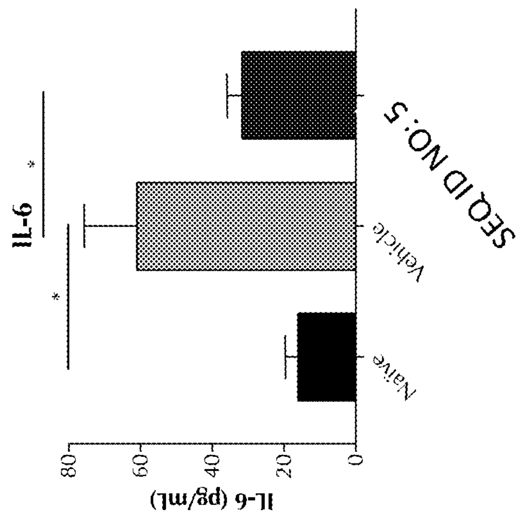
FIGS. 82A-82G illustrate expression of inflammatory markers upon treatment with an oral IL-10 delivery construct (SEQ ID NO: 5).
Figure 82A:
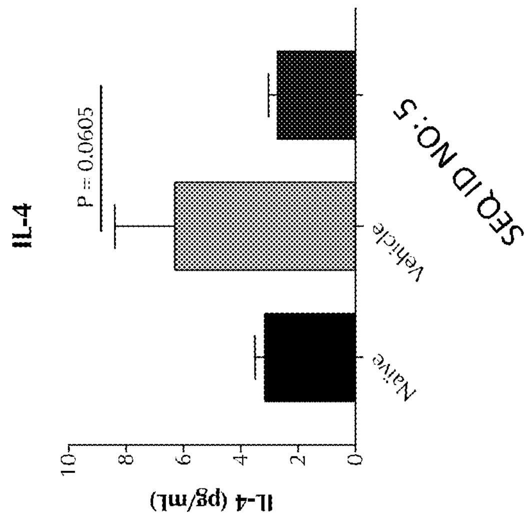
Figure 82D:
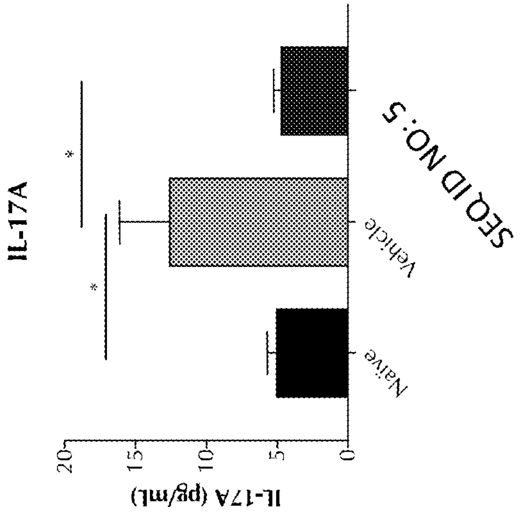
Figure 82C:
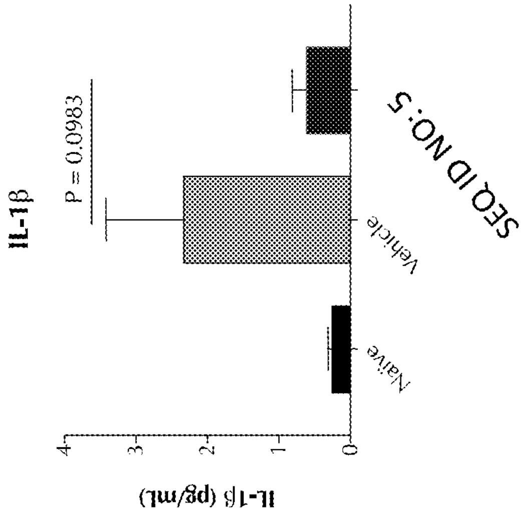
Figure 82F:
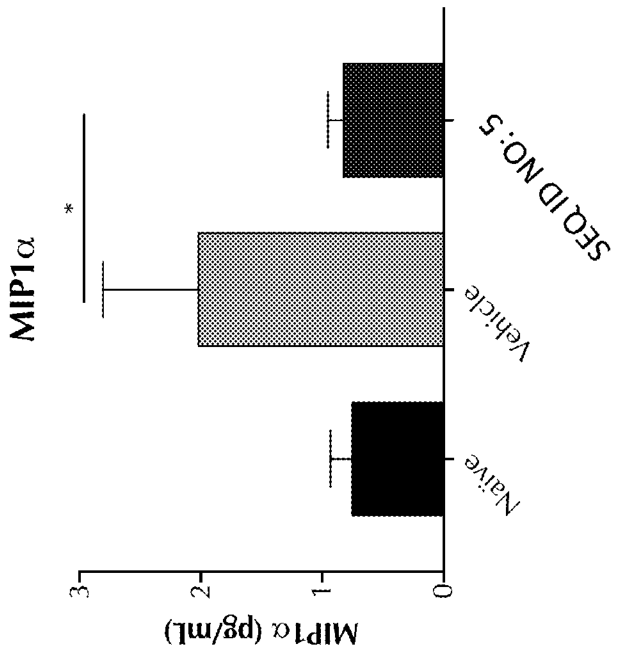
Figure 82E:
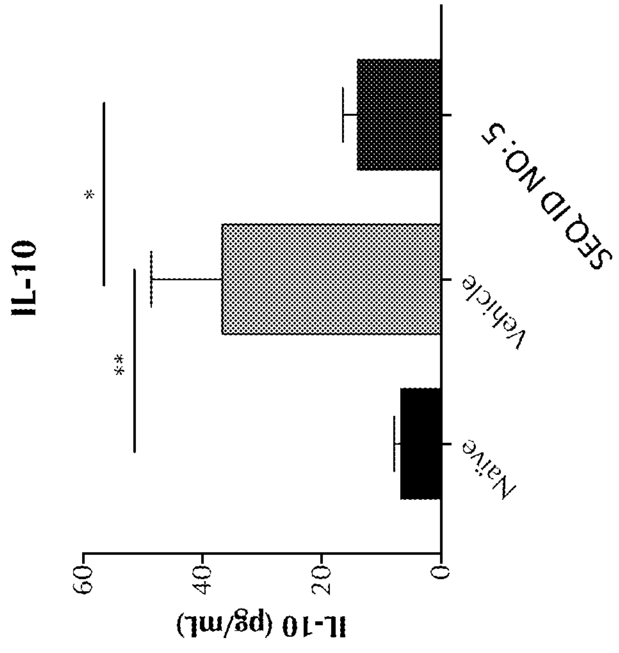
Figure 82G:
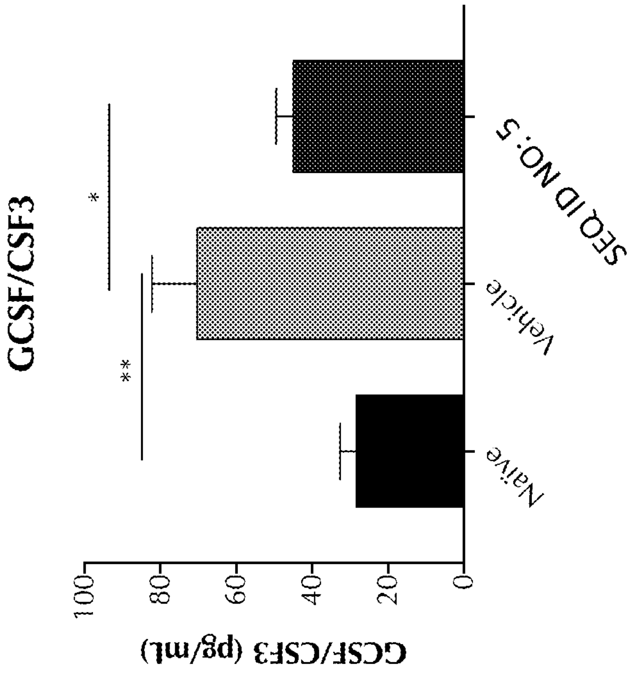

Treatment with an oral IL-10 delivery construct (SEQ ID NO: 5) decreased expression of inflammatory markers IL-4 (FIG. 82A), IL-6 (FIG. 82B), IL-1β (FIG. 82C), IL-17A (FIG. 82D), IL-10 (FIG. 82E), MIP1α (FIG. 82F), and GCSF/CSF3 (FIG. 82G). Statistical analysis was performed using a 1-way ANOVA with Tukey's post test.

Figure 84:
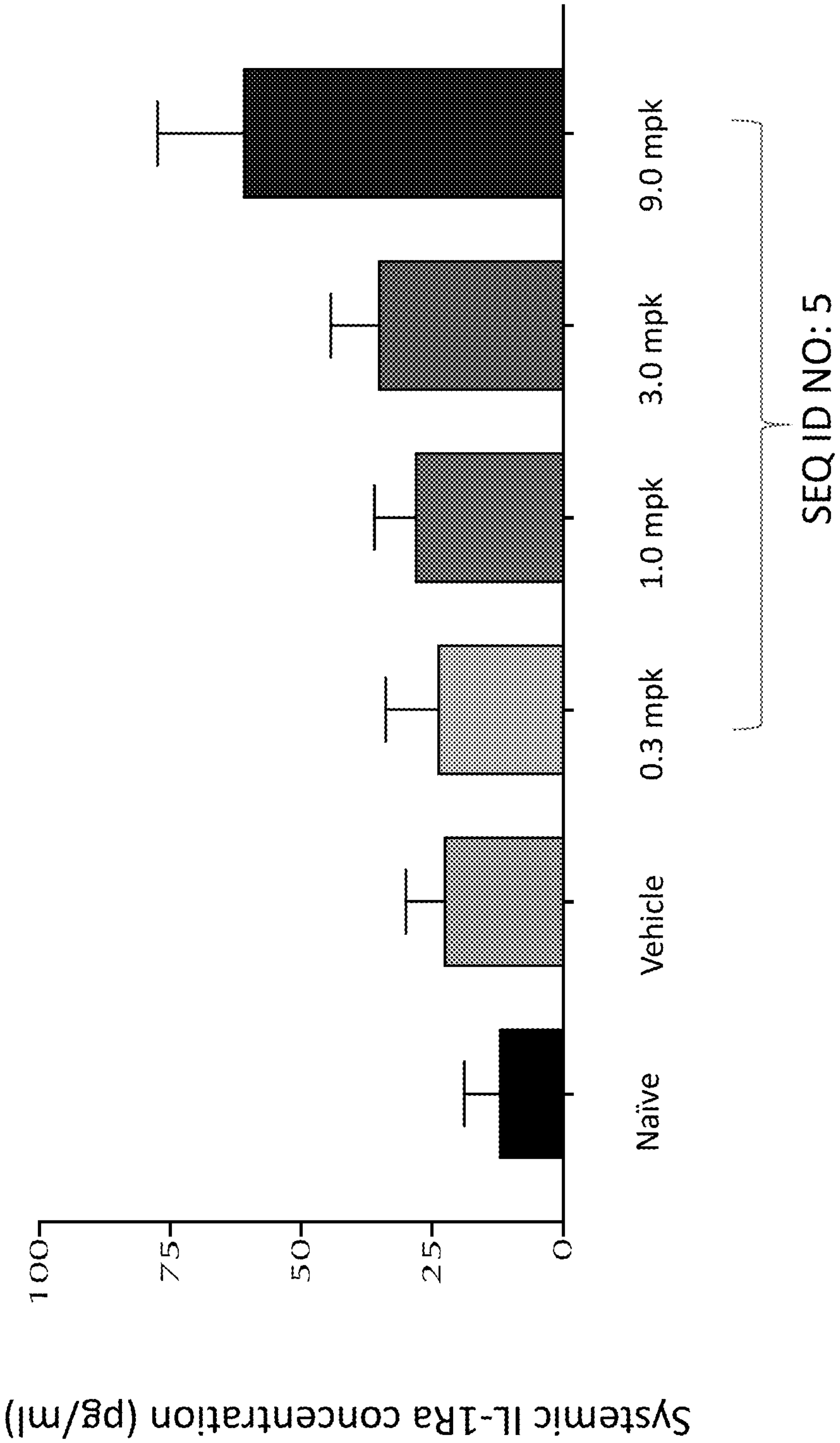
FIG. 84 illustrates systemic expression of IL-1Ra upon treatment with the IL-10 delivery construct (doses are shown on x axis in mg/kg).
Figure 85B:
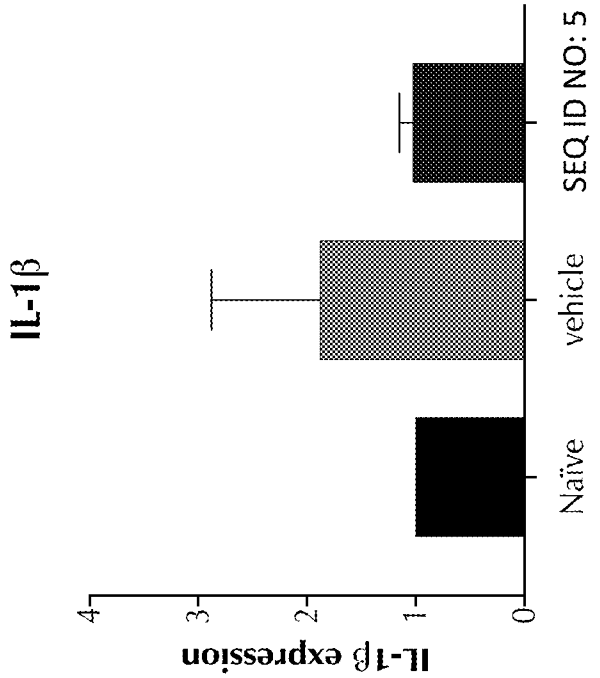
FIG. 85B illustrates colon expression of IL-1 in mice treated with vehicle or 9 mg/kg of an IL-10 delivery construct (SEQ ID NO: 5) as measured by qPCR and normalized to the expression level in a naïve mouse.
Figure 85A:
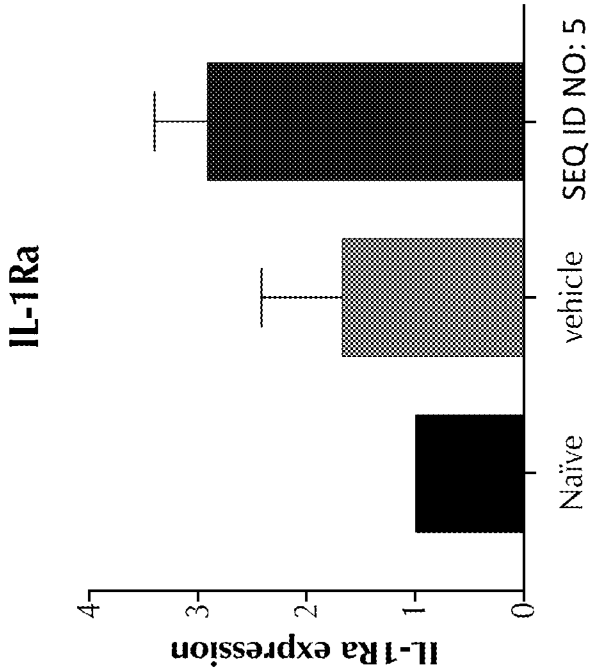
FIG. 85A illustrates colon expression of IL-1Ra in mice treated with vehicle or 9 mg/kg of an IL-10 delivery construct (SEQ ID NO: 5) as measured by qPCR and normalized to the expression level in a naïve mouse.
Figure 85C:
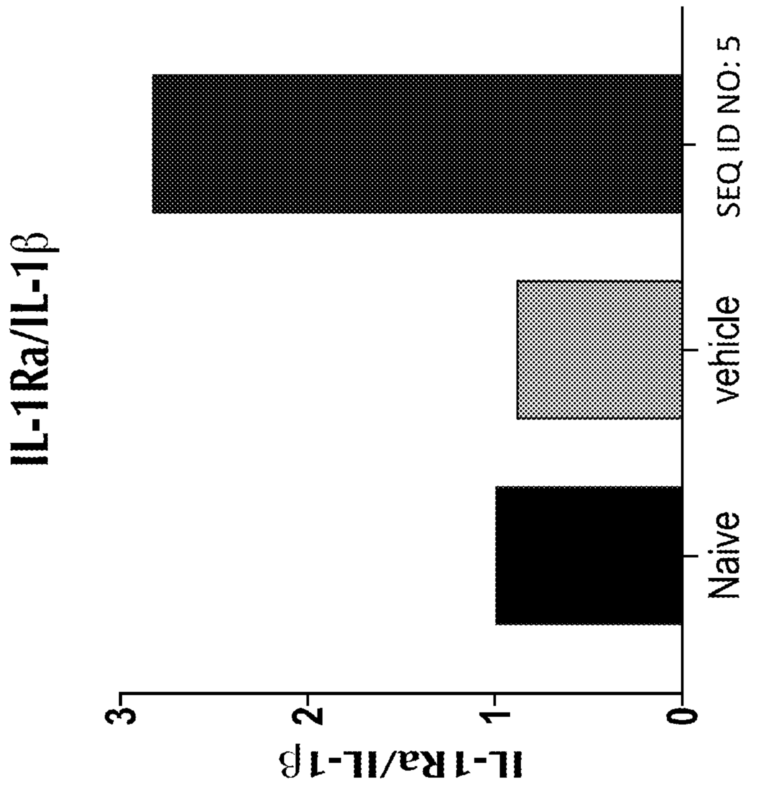
FIG. 85C illustrates the ratio of IL-1Ra to IL-1 in FIGS. 85A and B.
Figure 86:
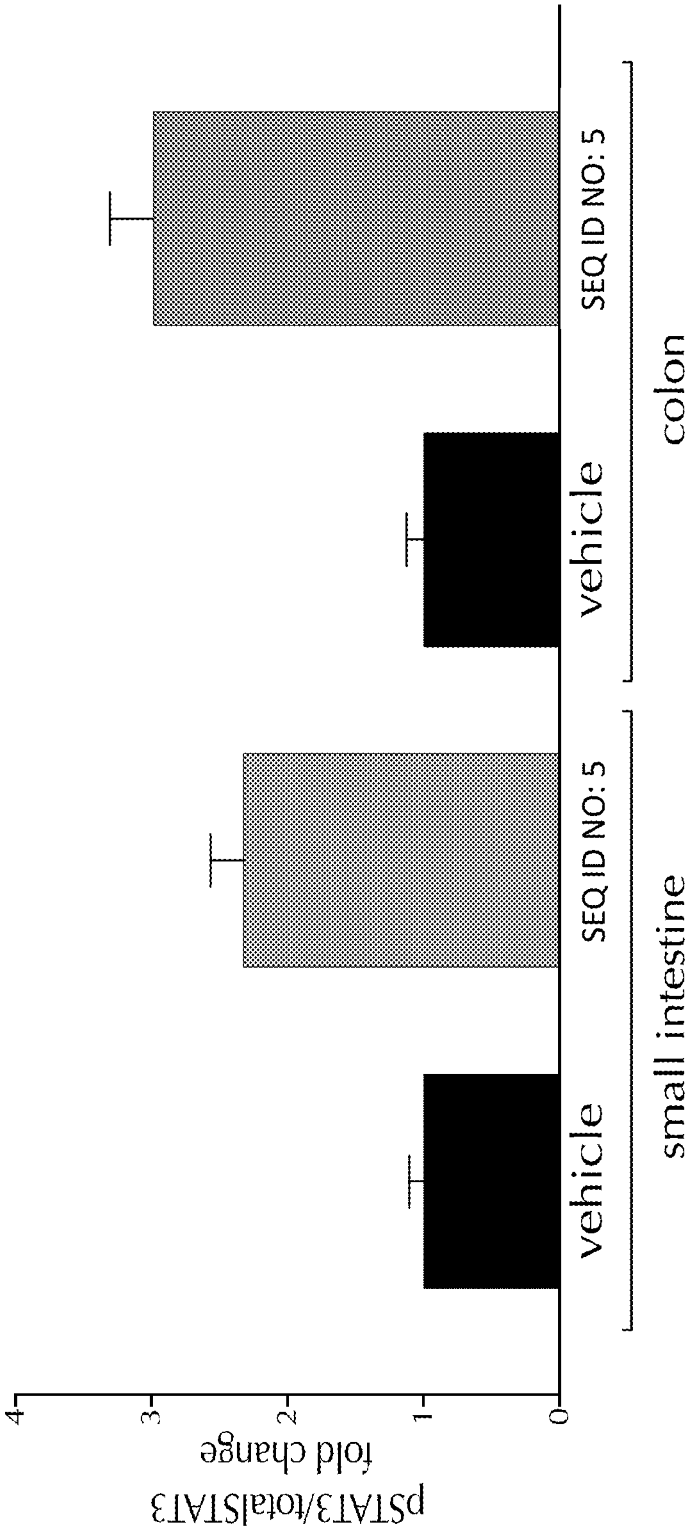
FIG. 86 illustrates the effect of treatment with an IL-10 delivery construct on the ratio of phosphorylated STAT3 (pSTAT3) to total STAT3 in colon tissue.

Treatment with the oral IL-10 delivery construct (SEQ ID NO: 5) induced upregulation of tissue and circulating biomarkers. FIG. 84 shows that systemic expression of IL-1Ra increased in a dose dependent manner upon treatment with the IL-10 delivery construct (doses are shown on x axis in mg/kg). Treatment with 9 mg/kg of the IL-10 delivery construct (SEQ ID NO: 5) increased colon expression of IL-1Ra compared to vehicle (FIG. 85A), decreased colon expression of IL-1β compared to vehicle (FIG. 85B) and increased the ratio of IL-1Ra to IL-1β by about 2.5 fold (FIG. 85C). Treatment with the IL-10 delivery construct increased the ratio of phosphorylated STAT3 (pSTAT3) to total STAT3 by about 2 fold in small intestine tissue and about 3 fold in colon tissue (FIG. 86).

Figure 83A:
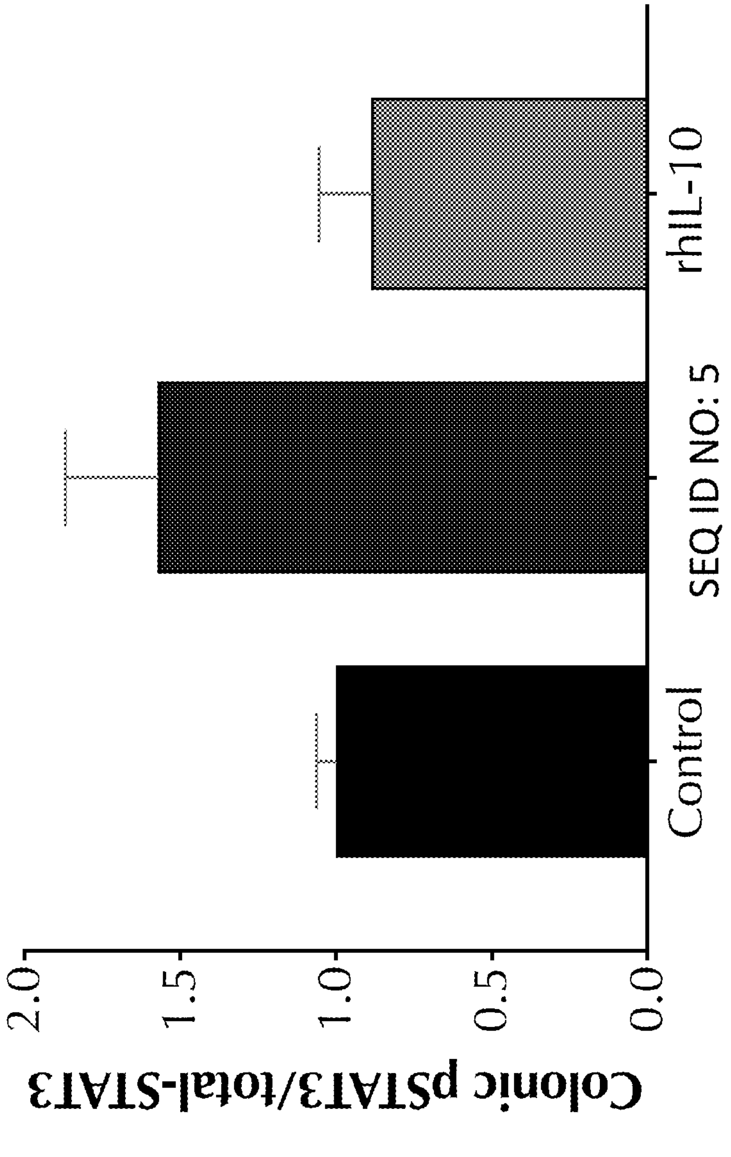
FIG. 83A illustrates the ratio of pSTAT3 to total STAT3 after treatment with an equimolar amount of either an IL-10 delivery construct (SEQ ID NO: 5; 1 mg/kg) or recombinant human IL-10 (0.9 mg/kg).

Example 23—Assessment of Effects of an IL-10 Delivery Construct (SEQ ID NO: 5) on STAT3 in Colon Tissue in Non-Inflamed Mice To assess the effect of an oral IL-10 delivery construct on STAT3 in non-inflamed colon tissue mice were administered with vehicle, an IL-10 delivery construct (1 mg/kg) or recombinant human IL-10 (rhIL-10, 0.9 mg/kg, an equimolar dose to that of the IL-10 delivery construct. Total STAT3 and phosphorylated STAT3 (pSTAT3) were assayed by ELISA MSD. FIG. 83A shows that treatment with the IL-10 delivery construct resulted in an approximately 50% increase in the ratio of pSTAT3 to total STAT3, while the rhIL-10 treatment did not significantly alter the ratio of pSTAT3 to total STAT3.

Figure 83B:
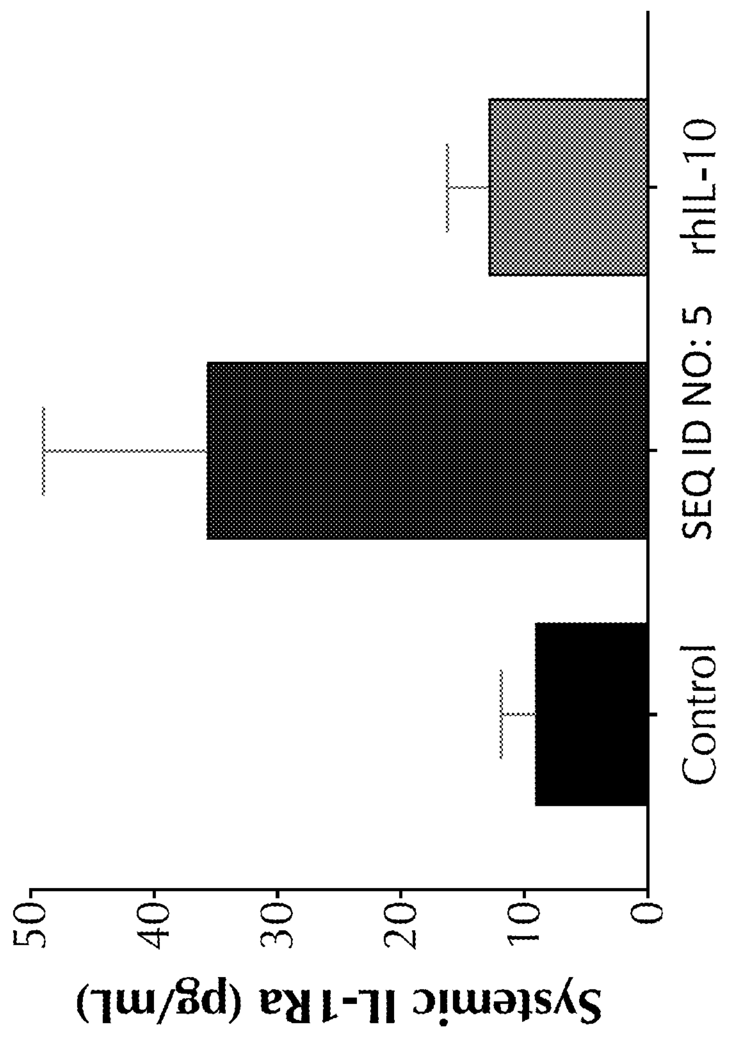
FIG. 83B illustrates the level of systemic IL-1Ra after treatment with an equimolar amount of either an IL-10 delivery construct (SEQ ID NO: 5; 10 mg/kg) or recombinant human IL-10 (3 mg/kg).

To assess the effect of an oral IL-10 delivery construct on IL-1Ra in non-inflamed colon tissue mice were administered with vehicle, an IL-10 delivery construct (10 mg/kg) or recombinant human IL-10 (rhIL-10, 3 mg/kg, an equimolar dose to that of the IL-10 delivery construct. Systemic IL-1Ra was assayed by ELISA MSD. FIG. 83B shows the level of systemic IL-1Ra was increased by about 3-fold in the mice treated with the IL-10 delivery construct, while the treatment with rhIL-10 did not significantly increase systemic IL-1Ra levels.

Figure 87:
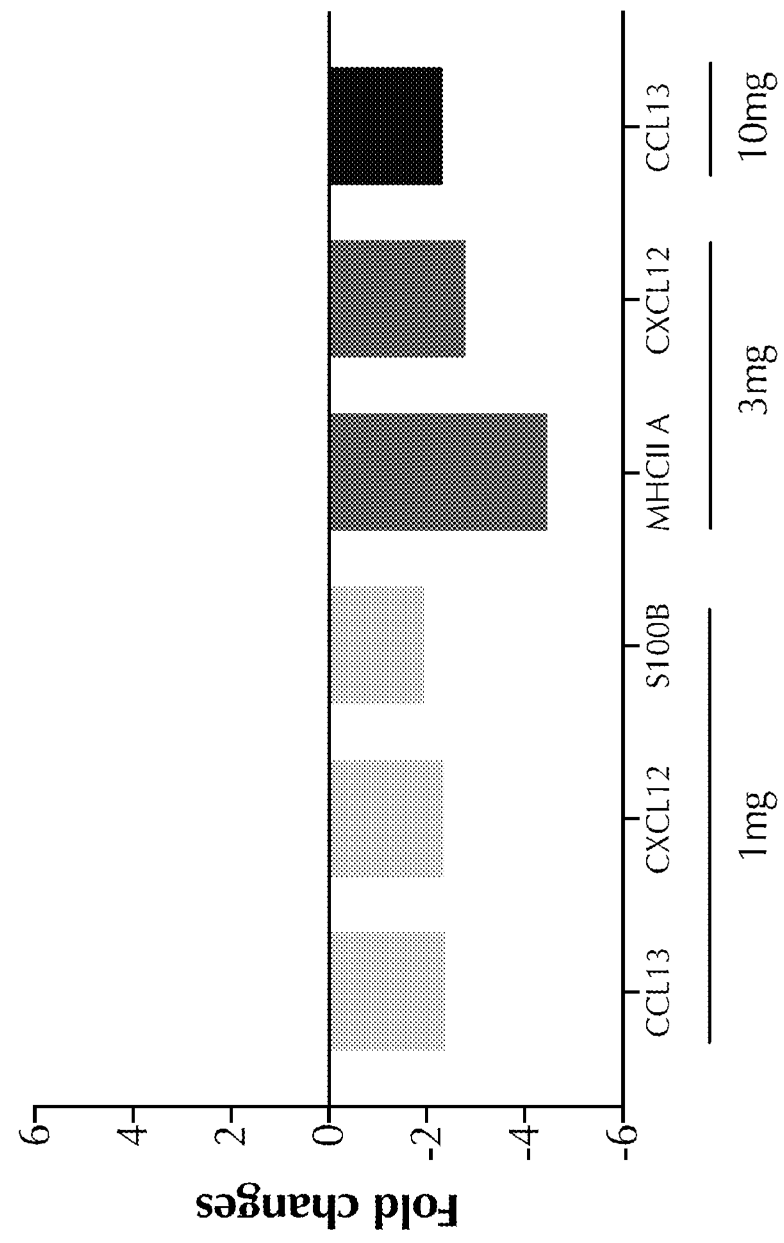
FIG. 87 illustrates expression of pro-inflammatory markers in *Macaca fascicularis* monkeys (about 5 to about 8 kg) administered an IL-10 delivery construct by colonic sigmoidoscopy at the indicated doses.
Figure 88:
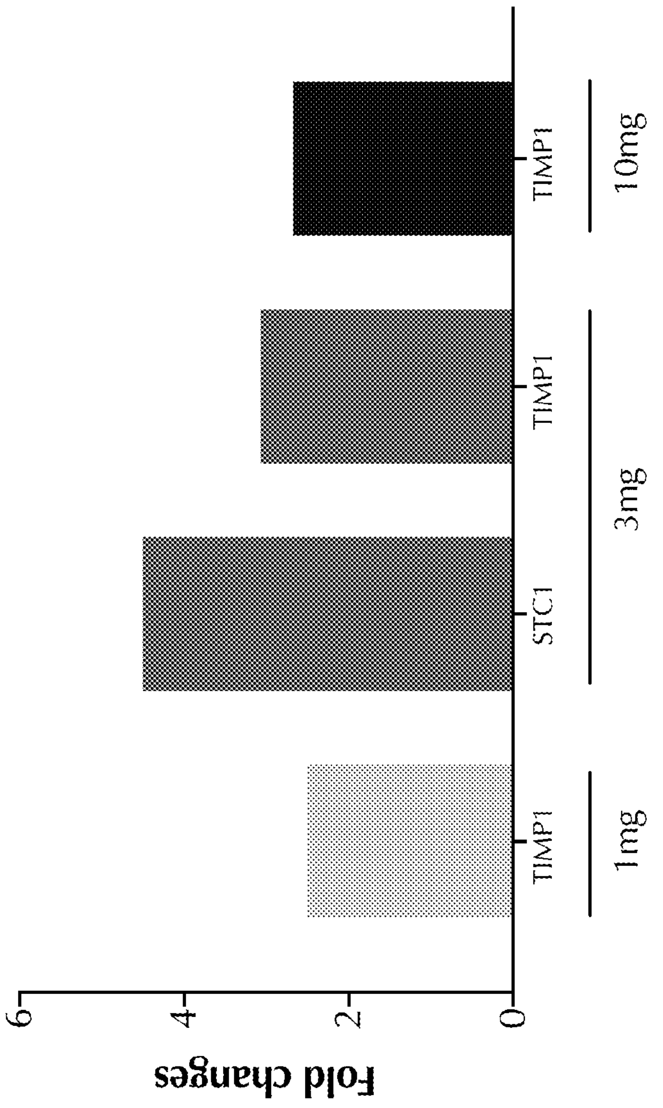
FIG. 88 illustrates expression of anti-inflammatory markers in *Macaca fascicularis* monkeys (about 5 to about 8 kg) administered an IL-10 delivery construct by colonic sigmoidoscopy at the indicated doses.
Figure 89:
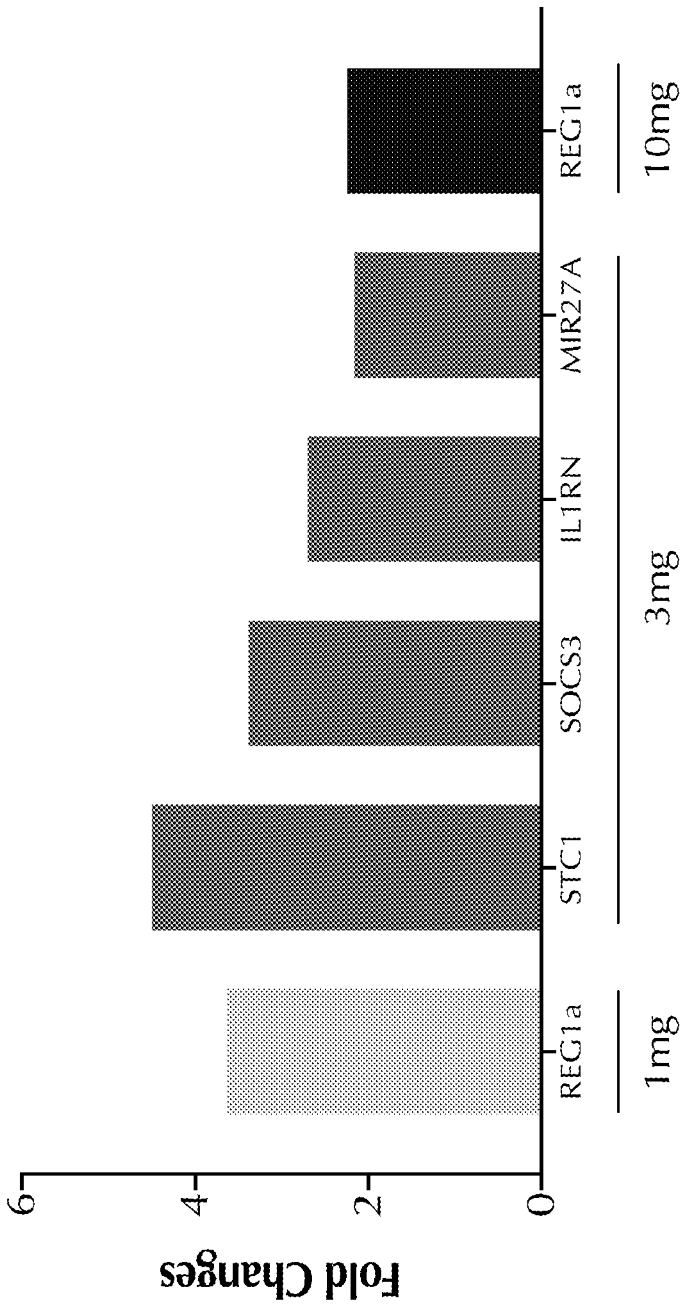
FIG. 89 illustrates expression of biomarkers associated with tissue repair and wound healing in *Macaca fascicularis* monkeys (about 5 to about 8 kg) administered an IL-10 delivery construct by colonic sigmoidoscopy at the indicated doses.

Example 24—Assessment of Effects of an IL-10 Delivery Construct (SEQ ID NO: 5) on Immune Homeostasis and Wound Healing in Non-Human Primates To assess the effect of an IL-10 delivery construct on pro-inflammatory and anti-inflammatory markers the IL-10 delivery construct was delivered to male *Macaca fascicularis* monkeys (about 5 to about 8 kg) by colonic sigmoidoscopy with a spray nozzle. The IL-10 delivery construct was administered at doses of 1 mg, 3 mg, and 10 mg formulated in albumin. Treatment with the IL-10 delivery construct decreased expression of pro-inflammatory markers (FIG. 87), increased expression of anti-inflammatory markers (FIG. 88) and increased expression of biomarkers associated with tissue repair and wound healing (FIG. 89).

Figure 90A:
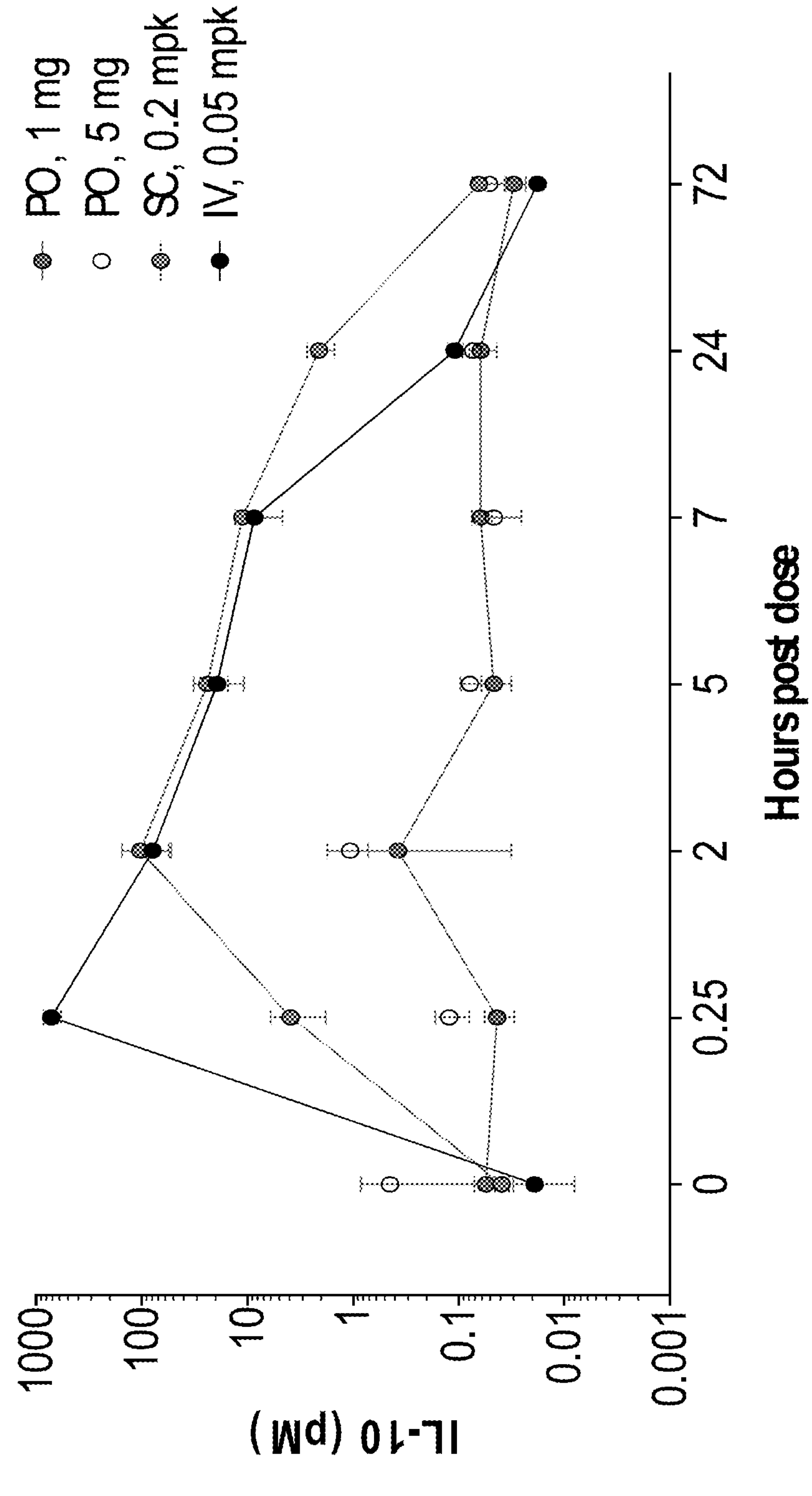
FIGS. 90A-90B illustrate PK and PD measurements in non-human primates following administration of an IL-10 delivery construct (SEQ ID NO: 5).
Figure 90B:
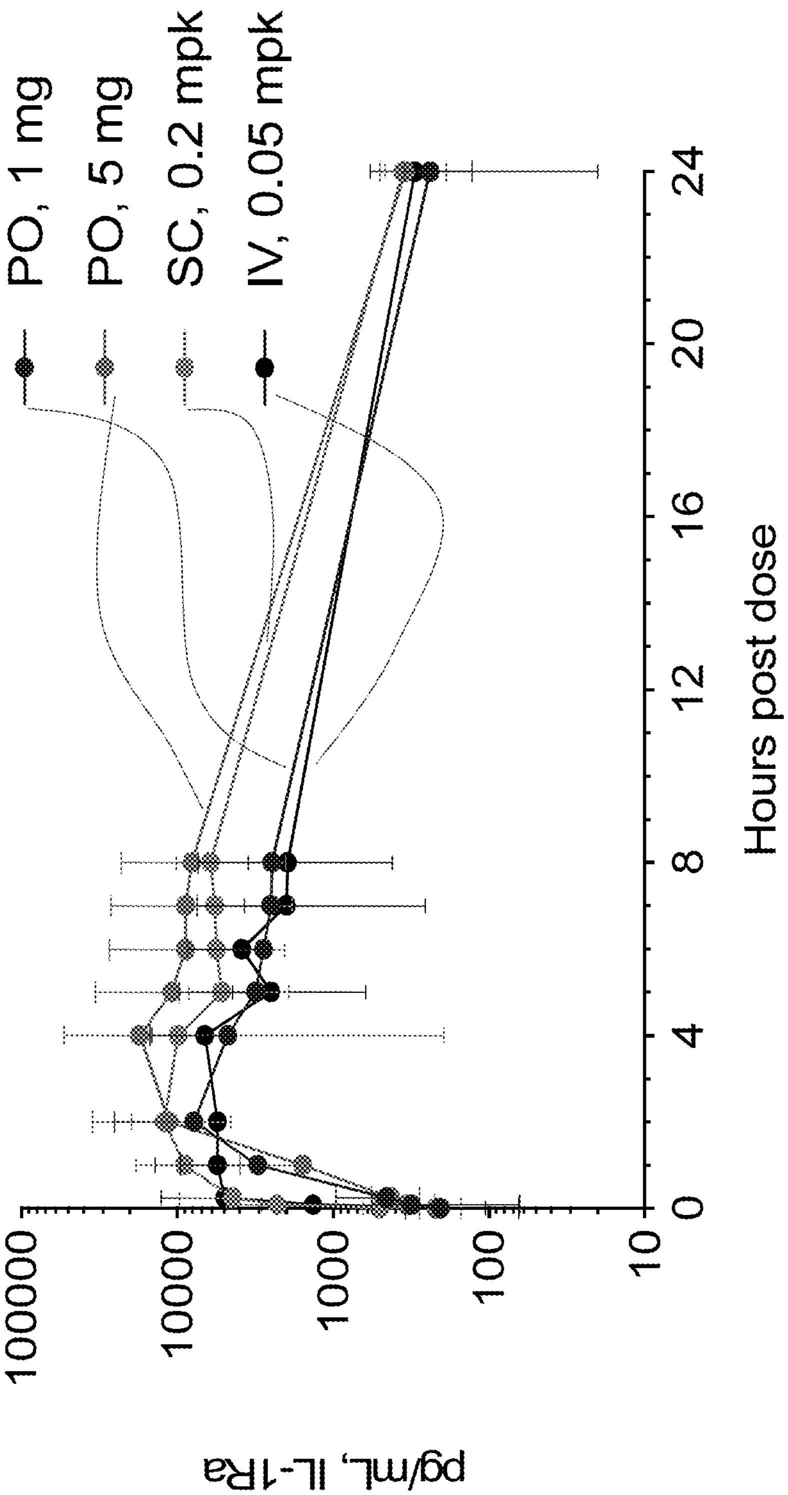
Figure 91:
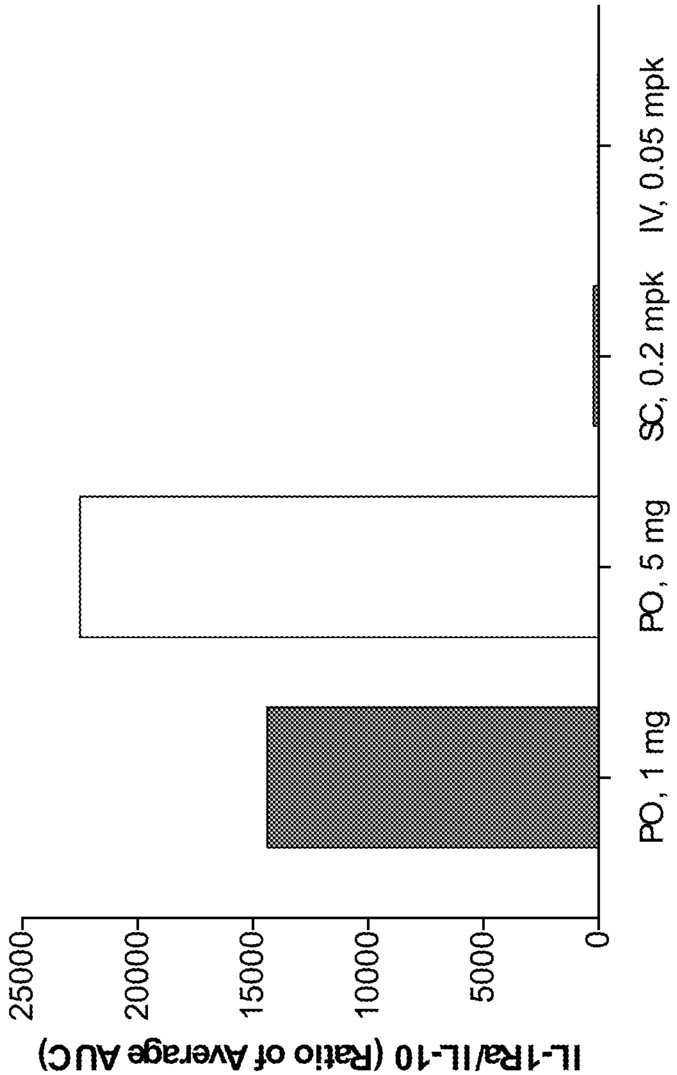
FIG. 91 illustrates the ratio of IL-1Ra to IL-10 (Ratio of the average AUC) after delivery of an IL-10 delivery construct orally (PO, N=6), subcutaneously (SC, N=3), or intravenously (IV, N=3) at the indicated doses in *Macaca fascicularis* monkeys.

Example 25—Assessment of the Pharmacokinetics and Pharmacodynamics of an IL-10 Delivery Construct (SEQ ID NO: 5) in Non-Human Primates To compare different routes of delivery an IL-10 delivery construct (SEQ ID NO: 5) was administered to *Macaca fascicularis* monkeys orally at 1 mg (N=6) or 5 mgs (N=6), subcutaneously at 0.2 mg/kg (N=3), or intravenously at 0.05 mg/kg (N=3). For oral administration the IL-10 delivery construct was formulated in size 0 enteric coated capsules. For intravenous or subcutaneous administration it was formulated as a liquid in DS lyo formulation. Oral treatment with the IL-10 delivery construct resulted in minimal systemic levels of IL-10 compared to either the subcutaneous or intravenous administration (FIG. 90A). Systemic levels of IL-1Ra are shown in FIG. 90B. Oral treatment with the IL-10 delivery construct increased the IL-1Ra/IL-1β ratio to about 15,000:1 at 1 mg, and greater than 20,000:1 for the 3 mg dose, while minimal effect was seen from either subcutaneous or intravenous administration (FIG. 91).

Example 26—Evaluation of Surfactants

The effect of surfactants on the dimerization of an IL-10 delivery construct (SEQ ID NO: 5), before and after being subjected to shear stress, was investigated. More particularly, various surfactants were added to solutions comprising IL-10 delivery construct (SEQ ID NO:5), and the resulting solutions were tested before being subjected to shear stress, and after being vortexed at 800 rpm continuously for 4 hours. The following surfactants were considered: (1) control (1×PBS, no surfactant), (2) polysorbate 80 (PS80), 0.1% in 1×PBS, (3) polysorbate 20 (PS20), 0.1% in 1×PBS, and poloxamer 188 (F68), 0.3% in 1×PBS.

Figure 92:
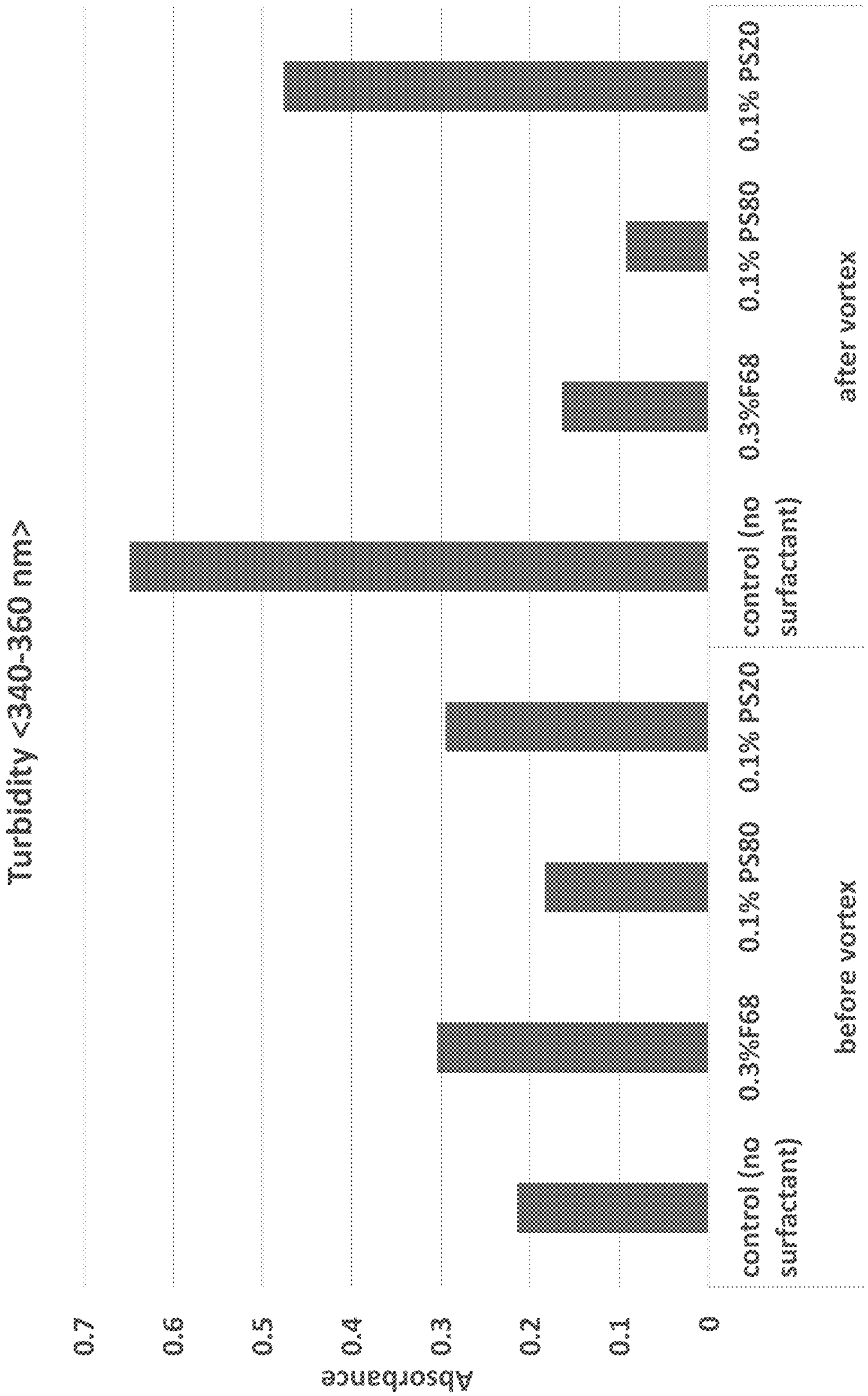
FIG. 92 illustrates the turbidity of solutions comprising an IL-10 delivery construct before and after vortexing, both with and without a surfactant.

Following vortexing, the solution was visually inspected. The sample without a surfactant was slightly hazy while the samples with the surfactant were clear after vortexing. The turbidity (340-360 nm) of the solution was assessed after vortexing. Without a surfactant, absorbance increased in the 340-360 nm range (FIG. 92), and an increase in absorbance was also observed with 0.1% PS20.

Figure 93:
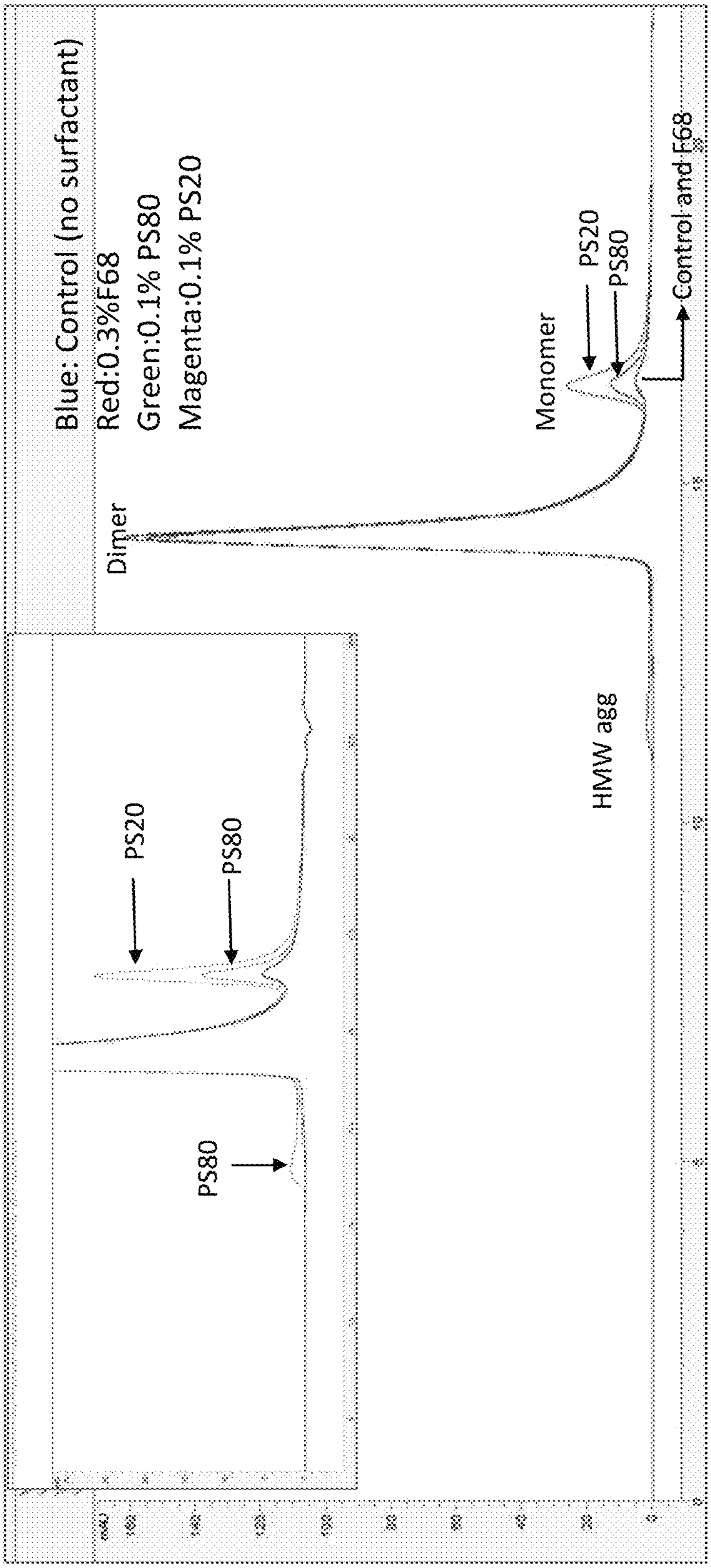
FIG. 93 illustrates an SEC-HPLC chromatogram prior to vortexing.
Figure 94:
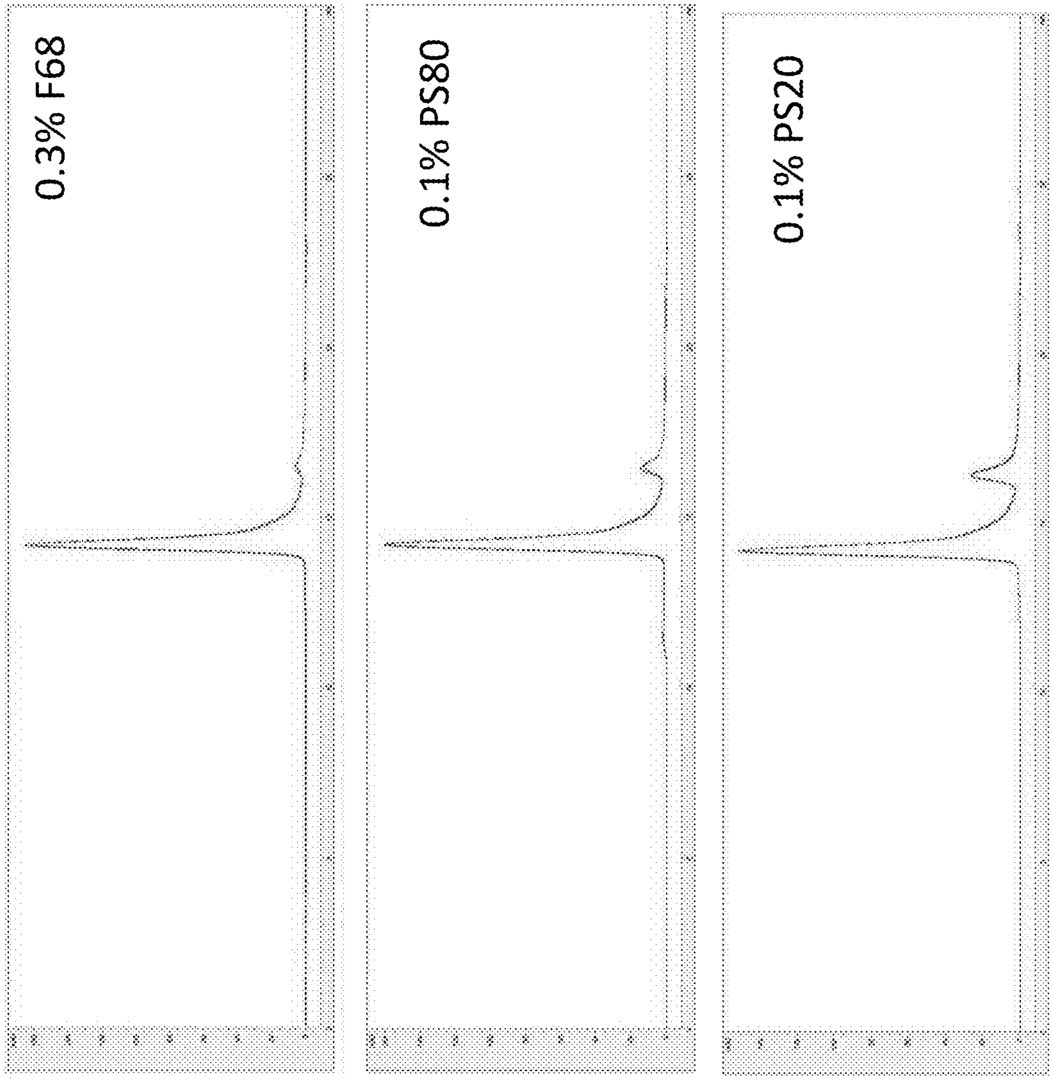
FIG. 94 illustrates an SEC-HPLC chromatogram after vortexing.

SEC-HPLC was carried out on the IL-10 delivery construct formulations before (FIG. 93) and after (FIG. 94) vortexing (TABLE 48). These results did not show significant changes before and after vortexing for all samples of the IL-10 delivery construct. However, polysorbate 80 showed an increase in HMW aggregates and monomers (of the IL-10 delivery construct) before vortexing, indicating some destabilizing effect on the IL-10 delivery construct. Additionally, polysorbate 20 showed the most amount of monomer before vortexing, indicating the occurrence of some dissociation of the IL-10 delivery construct. In conclusion, the surfactant F68 (poloxamer 188) at 0.3% seemed to stabilize the IL-10 delivery construct in 1×PBS under shear stress.

TABLE 48

Percent IL-10 delivery construct in monomer, dimer, and aggregate (HMW) forms as assessed by SEC-HPLC before and after vortexing

| SEC (%) | Before vortex control | Before vortex 0.3% F68 | Before vortex 0.1% PS80 | Before vortex 0.1% PS20 | After vortex control | After vortex 0.3% F68 | After vortex 0.1% PS80 | After vortex 0.1% PS20 |
|---|---|---|---|---|---|---|---|---|
| HMW | 0.57 | 0.49 | 3.47 | 0.9 | 0.82 | 0.81 | 3.43 | 0.94 |
| Dimer | 93.6 | 94 | 87.3 | 82.5 | 92.5 | 93.5 | 86.6 | 82.9 |
| Monomer | 5.81 | 5.5 | 9.2 | 16.65 | 6.73 | 5.66 | 10 | 16.17 |

Example 27—In Vivo Evaluation of pSTAT3

In vivo studies in mice were performed where the biological activity of human IL-10 following transcytosis was assessed for its ability to stimulate the mouse IL-10 receptor and increase phosphorylation of STAT3 (pSTAT3) in cells within the lamina propria. These studies demonstrated that an IL-10 delivery construct (SEQ ID NO: 5) (and not IL-10 alone without the carrier molecule) was shown to selectively transport across the epithelial cells and was capable of increasing STAT3 phosphorylation in cells within the lamina propria after transport across epithelial cells. Additionally, IL-10 delivery construct (SEQ ID NO: 5) exposure was increased in intestinal tissues and systemic exposure was minimized.

Intraluminal injection of IL-10 delivery construct (SEQ ID NO: 5) increased phosphorylation of STAT3 in cells within the lamina propria. Tissue localization of rhIL-10 and pSTAT3 was detected by immunofluorescence confocal microscopy about 10 minutes after intraluminal injection of IL-10 delivery construct (SEQ ID NO: 5) into the jejunum of Balb/C mice (FIG. 107). An extensive amount of rhIL-10 (SEQ ID NO: 5) was trafficked through enterocytes. Additionally, there were a population of lymphocyte-like cells at the basolateral surface of enterocytes and within the lamina propria that were pSTAT3 positive. Increases in phosphorylation of pSTAT3 over time are shown in FIG. 108.

Trafficking of IL-10 delivery construct across intestinal epithelium was validated in different murine models, as shown by confocal microscopy (FIG. 109).

Entire intestines of mice were isolated and processed as a "swiss role" and localization of pSTAT3 was detected by immunofluorescence confocal microscopy (FIG. 110). IL-10 activity was demonstrated along the length of intestine (in all intestinal segments, including colon) after oral gavage via detection of STAT3 phosphorylation along lamina propria, indicative of immunological signaling pathway activation.

Example 28—Intraluminal Injections of SEQ ID NO: 5 in the T-Cell Transfer Model of Inflammatory Bowel Disease This study was conducted to examine the potential for the carrier protein to transport rhIL-10 from the intestinal lumen into the submucosal region in inflamed intestinal tissue. The T lymphocyte (T cell) transfer model was used as it is a well-established model of induced chronic colitis in mice and presents many of the essential immunological hallmarks observed in IBD patients. Nine BALB/c mice and twelve SCID mice, including nine with the colitis-like model of inflammation, were dosed with 20 μl of test article via intraluminal injection into the distal ileum and the proximal, middle and distal colon. 159 pmoles IL-10 delivery construct (SEQ ID NO: 5) was administered to healthy BALB/c mice and SCID mice with induced colitis, 159 pmoles rhIL-10 was administered to healthy BALB/c mice and SCID mice with induced colitis, and PBS vehicle was administered to healthy BALB/c mice and both healthy and induced colitis SCID mice (n=3/group). In each group, two mice were terminated 10 minutes after intraluminal injections, and one was terminated 40 minutes after intraluminal injections. Intestinal tissue and serum were collected. Collected tissue was fixed, embedded, sectioned and H&E stained for histological assessment of inflammatory status. ELISA analysis to measure rhIL 10 was performed on lysates prepared from intestinal tissue and serum (FIGS. 106A-106D).

Histopathological assessment of tissue confirmed inflammation in all the SCID T cell transfer mice at all levels of the colon.

ELISA measurement of rhIL-10 at the 10-minute exposure time point was substantially higher in IL-10 delivery construct (SEQ ID NO: 5) injected mice compared to the mice injected with rhIL-10 alone (FIGS. 106A-106B). Furthermore, IL-10 delivery construct (SEQ ID NO: 5) transported into inflamed tissues more efficiently than in non-inflamed tissues. In normal intestinal tissues, IL-10 delivery construct (SEQ ID NO: 5) uptake was two- to five-fold higher compared to mice injected with rhIL-10 alone. In inflamed tissue, rhIL-10 levels measured after IL-10 delivery construct (SEQ ID NO: 5) injection were approximately 10-fold higher than those measured after rhIL-10 alone (FIG. 106B). Recombinant human IL-10 detected following IL-10 delivery construct (SEQ ID NO: 5) administration was detected 40 minutes post exposure time in most tissues, but appeared to be more stable in healthy compared to inflamed tissue (FIGS. 106C-106D).

IL-10 delivery construct (SEQ ID NO: 5), but not rhIL-10 administration, resulted in moderately high rhIL-10 detected in the serum of healthy animals, in a time-dependent manner. In inflamed animals, minimal amounts of rhIL-10 were detected in the serum, from both IL-10 delivery construct (SEQ ID NO: 5) and rhIL-10 intraluminal injections, indicating some mild non-specific leakage in the inflamed intestinal tissues.

The difference in systemic exposure in healthy vs. diseased mice may be attributed to an intestinal 'sink effect', that describes the higher number of infiltrated immune cells in disease state to which IL-10 delivery construct (SEQ ID NO: 5) can target. The numerous infiltrating leukocytes, as observed by histopathology in the intestinal mucosa and submucosa, restrict IL-10 delivery construct (SEQ ID NO: 5)/rhIL-10 to the lamina propria while limiting systemic exposure. IL-10 delivery construct (SEQ ID NO: 5) administration resulted in enhanced intestinal uptake of rhIL-10 in colonic tissues, which is evidence that cholix$^{386}$ facilitates the transcytosis of rhIL-10 through the epithelium.

Example 29—Phase 1a Clinical Study

The IL-10 delivery construct (SEQ ID NO: 5) was designed to assess the safety and tolerability, pharmacokinetics and pharmacodynamics of increasing single oral doses of the IL-10 delivery construct in healthy male subjects (Part A). In part B of the study, early data was gathered on the safety and tolerability, pharmacokinetics, pharmacodynamics and early clinical response following multiple ascending doses of the IL-10 delivery construct in Ulcerative Colitis (UC) patients (Part B).

The primary objective was to assess the safety and tolerability of single and multiple ascending doses of the IL-10 delivery construct in healthy adult volunteers and patients with active UC. Other objectives of the study were to assess: pharmacokinetics (PK) and pharmacodynamics (PD) of the IL-10 delivery construct, to assess the incidence of anti-drug antibodies against the IL-10 delivery construct, to evaluate potential PD biomarkers of the IL-10 delivery construct in plasma and tissue (Part B only), to assess the delivery of the IL-10 delivery construct to colonic tissue based on PD response and to assess clinical activity of the IL-10 delivery construct after two weeks of treatment in patients with active UC.

Phase 1a Trial Design

Part A consisted of a single-ascending dose (SAD) escalation in healthy male volunteers. Six cohorts consisting of orally administered single ascending doses were conducted. At each dose level, 6 subjects were enrolled, randomized 2:4 to receive a single dose of placebo or the IL-10 delivery construct on day 1. The doses selected were 1 mg, 3 mg, 10 mg, 30 mg, 60 mg, and 120 mg.

Preliminary Phase 1a Data

The results of Part A confirm that the IL-10 delivery construct is safe and well tolerated. A total of 3 adverse events occurred, with 1 in 12 placebo patients and 2 in a total of 24 active the IL-10 delivery construct patients. All events were mild, self-limiting adverse events. Results of the pharmacokinetic analyses from all doses (1-120 mg) confirmed that the IL-10 delivery construct was gut-selective as no drug was detected in the blood.

Pre-clinical models have identified peripheral IL-1Ra production as a marker of IL-10 engagement to IL-10R in mucosal lymphocytes. To determine if the IL-10 delivery construct was actively transported across the epithelial cell lining into the lamina propria and able to interact with lymphocytes, the levels of IL-1Ra induction was assessed.

The results confirmed that the IL-10 delivery construct was able to induce IL-1Ra expression (FIG. 111). The loss of immunomodulatory activity (IL-1Ra induction) at 60 and 120 mg is consistent with IL10 biology.

Example 30—Phase 1b Clinical Study

Data was gathered on the safety, tolerability, pharmacokinetics, pharmacodynamics, and initial clinical response following a multiple ascending dose (MAD) of the IL-10 delivery construct in adult patients with active UC over 14 days of treatment. A lyophilized composition of the IL-10 delivery construct and excipients (glycine, sucrose, poloxamer 188, and potassium phosphate) was added to size 0 HPMC capsules to prepare three different batches with a dose strength of 1 mg, 5 mg, and 20 mg. A coating with a weight ratio of 50:50 of Eudragit® L30D55: Eudragit® FS30D was applied with a thickness of 14.8 to 16.0 mg/$cm^2$ and a weight of approximately 76 mg to each capsule. Placebo capsules were generated using similarly coated empty capsules.

Phase 1b Trial Design

As shown in FIG. 112, the Phase 1b trial consisted of a MAD escalation in adult patients with active UC. A total of four cohorts were dosed with either 1 mg, 3 mg, 10, mg or 30 mg of the IL-10 delivery construct, randomized 3:1 to receive the IL-10 delivery construct or a placebo administered once daily for fourteen days. The goal of the trial was to assess the safety of the IL-10 delivery construct and any change in UC disease activity, through endoscopy, histology, biomarkers, and serum samples. Stool samples and colonic biopsies were obtained at baseline and day 14 of treatment to assess fecal calprotectin as well as histology based upon blinded central read of the Geboes scoring system. Fecal calprotectin is an objective marker of clinical response in UC studies and the Geboes scoring system is a measure of histological response. The Geboes scoring system of this example used a 0-22 point histologic scoring system in which higher scores represent more severe disease.

Preliminary Phase 1b Data Has Demonstrated that Oral IL-10 Delivery Construct is Well Tolerated The results of the Phase 1b trial demonstrated that oral IL-10 delivery construct was observed to be well tolerated by patients with UC. TABLE 49 shows that a total of 23 TEAEs were observed including three in the four placebo patients, and 20 in the 12 active IL-10 delivery construct patients. The adverse events of the Phase 1b trial included nasopharyngitis and adverse events associated with underlying UC symptoms such as abdominal pain, diarrhea, and nausea. All adverse events were self-limiting and mild to moderate, with no adverse events warranting early discontinuation of treatment. Importantly, unlike systemically delivered IL-10 in previous studies, no treatment emergent AEs of anemia or thrombocytopenia were observed.

TABLE 49

Treatment-emergent adverse events (TEAEs) observed between active subjects and placebo

| | 1 mg (n = 3) | 3 mg (n = 3) | 10 mg (n = 3) | 30 mg (n = 3) | All Active (n = 12) | Placebo (n = 4) |
|---|---|---|---|---|---|---|
| # of TEASs (% pts) | 2 (67%) | 7 (67%) | 5 (67%) | 6 (67%) | 20 (67%) | 3 (50%) |

Preliminary Results of Clinical Response

Fecal calprotectin (FCP) is a clinical marker of disease activity in patients with UC. FCP values greater than 150 μg/g correlate with active inflammation. As can be seen in FIG. 113, dosing of 1 mg and 3 mg IL-10 delivery construct led to placebo-adjusted mean reductions of FCP of 44% and 27% after only 14 days of dosing. Previous clinical studies with systemically deliver IL-10 showed a diminution of activity at higher doses, which is also observed with the 10 mg and 30 mg doses of the IL-10 delivery construct.

C-Reactive Protein (CRP) is a biomarker of systemic inflammation. At 1 and 3 mgs, greater reductions in CRP levels were observed in UC patients with baseline CRP greater than 5 mg/L when compared to placebo (FIG. 114). By design, the IL-10 delivery construct is a GI-selective protein and was not detected in systemic circulation. However, reduction in CRP levels suggests that treating UC patients with oral GI-selective IL-10 delivery construct resulted in local intestinal as well as systemic immunomodulatory activity, which helps enable the treatment of peripheral inflammatory indications.

The Geboes histologic scoring system is a system that incorporates immune cell (lymphocyte and neutrophil) infiltration into the lamina propria and epithelium as well as crypt architecture and destruction, and the presence of ulcerations and erosions. When each component is added, the total score can range from 0 (normal) to 22 (severe inflammation and tissue destruction). To assess activity of the IL-10 delivery construct on the GI mucosa, colonic biopsies were obtained at baseline and then after 14 days of dosing, and Geboes scores were assessed by a blinded, central read GI pathologist. The IL-10 delivery construct reduced Geboes scores in 60% (6/10) active IL-10 delivery construct patients when compared to 0% (2/10) placebo patients (FIG. 115).

FIG. 116 shows pre-dose and post-treatment histological images from a UC patient in the Phase 1b trial dosed with 10 mg of the IL-10 delivery construct in which the Geboes score improved from a score of 15 to a score of three using a 22 point scale, with higher scores indicating more severe disease activity. The pre-dose image revealed the UC patient had crypt destruction and an inflammatory cellular infiltrate in their colon at baseline which are resolved in the post-treatment image after 14 days of treatment with the IL-10 delivery construct.

Example 31: Comparison of Purification of an IL-10 Delivery Construct with and without Sulfitolysis IL-10 delivery construct (SEQ ID NO: 5) was purified from inclusion bodies using a process including a sulfitolysis step as described in FIG. 2A, or an analogous process described in FIG. 2B but which did not include the sulfitolysis and tangential flow filtration steps between the clarification and refolding steps. Refolding in both processes was carried out at 4° C. The refolding solution used in both processes contained 1 mM reduced glutathione, 0.5 mM oxidized glutathione, 1M Arginine-HCl, 250 mM sucrose, 100 mM Tris pH 8.5 at 4° C., and 2 mM EDTA. IL-10 delivery construct (SEQ ID NO: 5) dimer content was characterized by SEC-HPLC following the ultrafiltration/diafiltration step after refolding but before AEX chromatography using a TSKgel SW3000 4 μm, 4.6/300 from Tosoh Biosciences (TABLE 50) and further characterized following AEX chromatography by the Capto Q ImpRes® (GE) chromatogram (TABLES 51-52).

TABLE 50

Percentage of IL-10 delivery construct (SEQ ID NO: 5) in various forms (high molecular weight aggregates, dimers, and monomers)

| Process type* | Aggregate % | Dimer % | Monomer % |
|---|---|---|---|
| Sulfitolysis of SIB (TFF-2 for 20 h at RT) | 68 | 17 | 8 |
| No Sulfitolysis of SIB (2x UF/DF at 4° C.) | 36 | 27 | 22 |
| No Sulfitolysis of SIB (2x UF/DF for 66 h RT) | 57 | 22 | 11 |

*included in parentheses is a description of the TFF step between refolding and AEX chromatography

TABLE 51

IL-10 delivery construct (SEQ ID NO: 5) yield after Capto Q Chromatography

| Process type | Capto Q Load (mg) | UFDF concentration (mg/mL) | Capto Q pool volume (mL) | Capto Q Yield | Dimer Purity (%) |
|---|---|---|---|---|---|
| Sulfitolysis of SIB (97 mL Capto Q) | 1680 | 1.85 | 270 | 151 | 74 |
| No Sulfitolysis of SIB (97 mL Capto Q) | 1680 | 1.68 | 270 | 262 | 84 |

TABLE 52

IL-10 delivery construct (SEQ ID NO: 5) dimer recovery after Capto Q Chromatography

| Process type | Dimer content in Capto Q Load (%) | Capto Q total protein recovery (%) | Capto Q Dimer Recovery (%) | Dimer Purity (%) |
|---|---|---|---|---|
| Sulfitolysis of SIB (average of 3) | 20 | 17 | 55 | 82-83 |
| Sulfitolysis of SIB (97 mL Capto Q) | 16.5 | 9 | 54.5 | 74 |
| No Sulfitolysis of SIB (97 mL Capto Q) | 25 | 15.6 | 62.4 | 84 |

Example 32: Comparison of Purification of an IL-10 Delivery Construct with and without Sulfitolysis This example demonstrates the in vivo transcytosis of the delivery construct consisting of the amino acid sequence set forth in SEQ ID NO: 5 across intact polarized gut epithelial cells in Wistar rats. The data demonstrates that the delivery construct rapidly and efficiently transported the IL-10 payload across the polarized gut epithelial cells into the lamina propria.

In vivo transcytosis was tested using male Wistar rats. Male Wistar rats were housed 3-5 per cage with a 12/12 h light/dark cycle and were about 225-275 g (approximately 6-8 weeks old) when placed on study. Experiments were conducted during the light phase using a non-recovery protocol that uses continuous isoflurane anesthesia. A 4-5 cm midline abdominal incision that exposed mid-jejunum regions was conducted. Stock solutions at $3.86\times10^{-5}$ M of delivery construct were prepared in phosphate buffered saline (PBS), with 50 μL (per 250 g rat) being administered by intraluminal injection (ILI) using a 29-gauge needle. The injection site mesentery was then marked with a permanent marker. At study termination, a 3-5 mm region that captured the marked intestine segment was isolated and processed for microscopic assessment. The in vivo experiments were performed in accordance with the U.K. Animals (Scientific Procedures) Act of 1986, the European Communities Council Directive of 1986 (86/609/EEC).

The results of the transcytosis activity of the delivery construct with SEQ ID NO: 5 are shown in FIGS. 117A-117C. The data shows microscopy images demonstrating transport of the IL-10 payload across polarized gut epithelial cells in Wistar rats at various time points following luminal application of the delivery construct with the sequence set forth in SEQ ID NO: 5 to rat jejunum. The delivery construct (SEQ ID NO: 5) included the cholix carrier with SEQ ID NO: 4 (and further including an N-terminal methionine) coupled to the IL-10 payload having an amino acid set forth in SEQ ID NO: 2 via a spacer having an amino acid set forth in SEQ ID NO: 6. Green fluorescence indicates the presence of IL-10 (via staining with an anti-IL-10 antibody). Blue fluorescence indicates DAPI staining, which labels DNA, and red fluorescence indicates the presence of CK-8 (cytokeratin-8) with which a cholix-derived carrier can co-localize (e.g., in a supranuclear region of an epithelial cell) during transcytosis. The white arrows #1 highlight the apical membrane of the epithelial cells, and the white arrows #2 highlight the basal membrane of the epithelial cells.

FIG. 117A demonstrates the extent of transcytosis of IL-10 one minute after luminal application of the delivery construct with the sequence set forth in SEQ ID NO: 5 to rat jejunum. The data shows that transport of the IL-10 payload from the apical to the basal site and into the lamina propria occurred as early as 1 minute after application of the delivery construct. White arrow #3 indicates the presence of IL-10 in the lamina propria.

FIG. 117B demonstrates the extent of transcytosis of IL-10 five minutes after luminal application of the delivery construct with the sequence set forth in SEQ ID NO: 5 to rat jejunum. The data shows an increased amount of transported IL-10 payload that was present in the lamina propria (see e.g., white arrows #3) 5 minutes after luminal application of the delivery construct.

FIG. 117C demonstrates the extent of transcytosis of IL-10 ten minutes after luminal application of the delivery construct with the sequence set forth in SEQ ID NO: 5 to rat jejunum. The data shows an even higher amount of transported IL-10 payload that was present in the lamina propria (see e.g., white arrows #3) 10 minutes after luminal application of the delivery construct.

This data demonstrates that the cholix-derived carrier with the sequence set forth in SEQ ID NO: 4 (and further including an N-terminal methionine) is capable of rapidly and efficiently transporting the IL-10 payload (SEQ ID NO: 2) across intact polarized gut epithelial cells in vivo as demonstrated by the presence of the IL-10 payload in the lamina propria as early as 1 minute after luminal application of the delivery construct (SEQ ID NO: 5). Over the course of this experiment, an increasing amount of transported IL-10 was detected in the lamina propria.

Example 33: The Elements of the Delivery Construct of SEQ ID NO: 5 are Functionally Active In Vitro This example provides a functional assessment of the ability of the cholix-derived carrier (SEQ ID NO: 4) to transport the IL-10 payload (SEQ ID NO: 2) across the intestinal epithelium was verified using polarized, confluent monolayers of human small intestinal cells cultured on semi-permeable membranes in vitro (FIG. 118). Despite the much larger molecular mass, the delivery construct (SEQ ID NO: 5) transported across these monolayers to a greater extent than recombinant, human IL-10 (rhIL-10), demonstrating that the cholix derived carrier of SEQ ID NO: 5 retains its capacity to undergo apical to basal (A→B) transcytosis. The delivery construct (SEQ ID NO: 5) was next tested in vitro to ensure that the IL-10 element of the fusion protein was biologically active. A U2OS osteosarcoma cell line engineered to express the two receptors involved in IL-10 signal transduction (IL-10RA and IL-10RB) and exhibit a luminescence event as a result of ligand-induced receptor dimerization was used to test increasing doses of the delivery construct, the cholix derived carrier alone and the rhIL-10 alone. The delivery construct had an EC50 of 971.4 pM compared to 91.53 pM for rhIL-10 (FIG. 119), while the cholix derived carrier alone did not induce IL-10R dimerization. To assess downstream potency, the potential for the delivery construct, rhIL-10, or the cholix derived carrier to induce phosphorylation of signal transduction and activator of transcription factor 3 (STAT3) was examined using the mouse macrophage J774.2 cells. The delivery construct of SEQ ID NO: 5 demonstrated an EC50 of 263.6 pM compared to 40.98 pM for a commercial preparation of hIL-10 in this assay (FIG. 120). Notably, the delivery construct has a reduced amplitude of pSTAT3/total STAT3 of ~1.47% compared to hIL-10 at 2.19%. Finally, pre-treatment of human peripheral blood mononuclear cells (PBMCs) with the delivery construct of SEQ ID NO: 5 resulted in a dose-dependent reduction of secreted tumor necrosis factor alpha (TNFα, FIG. 121) and surface expression of HLA-DR (FIG. 122), but not secreted IL-6 (FIG. 123), normally induced by endotoxin (lipopolysaccharide) treatment. Together, these data show that conjoining hIL-10 to the cholix derived carrier of SEQ ID NO: 4 through a GS polypeptide sequence spacer produced a chimera that retained the properties required to reach cells within the intestinal lamina propria and to activate IL-10 receptor signaling pathways in that compartment.

Example 34: The Delivery Construct of SEQ ID NO: 5 Transcytoses In Vivo

This example provides an assessment of whether the delivery construct of SEQ ID NO: 5 can undergo efficient transcytosis in vivo by examining pSTAT3 induction using of rat intestinal tissue isolated 40 min post oral gavage with PBS, rhIL-10, or the delivery construct. Immunofluorescence microscopy of tissues from PBS-treated animals failed to exhibit the presence of any immuno-reactivity for hIL-10 or pSTAT3 induction in either the lamina propria or intestinal epithelium (FIG. 124). In some instances, rhIL-10 treated animals exhibited pSTAT3 induction in enterocytes but not in cells within the lamina propria; no hIL-10 within the tissue was detected (FIG. 125). This observation is consistent with findings in mice that intestinal epithelial cells can express IL-10 receptors at their apical surface under certain conditions associated with development and maintenance of barrier function. Tissues isolated from animals treated with the IL-10 delivery construct of SEQ ID NO: 5 demonstrated extensive amounts of hIL-10 and a large number of cells that were positive for pSTAT3 within the lamina propria (FIG. 126). In order to quantify how test articles affected intestinal IL-10 signal transduction pathways, image analysis was performed: high-throughput image batches were collected, segmented by epithelial versus lamina propria localization, and then by cellular features. Resulting segmentation patterns allowed binary maps to be created that were applied to component data, resulting in intestinal villi distribution scoring of nuclear pSTAT3+ cells (FIG. 127). Tissues treated with the delivery construct of SEQ ID NO: 5 showed pSTAT3 induction in cells both within the lamina propria and in enterocytes that was greater than that observed in intestinal tissues collected from PBS- or rhIL-10-treated animals.

This example also assessed whether the delivery construct of SEQ ID NO: 5 could transport across inflamed intestinal tissue. A mouse model of colitis induced by transfer of CD4+CD45RBhigh T cells was used in an ILI format where ~160 pmoles of an IL-10 delivery construct or rhIL-10 was administered into the distal ileum or proximal, mid, or distal regions of the colon in PBS (FIG. 128). Histopathological microscopic assessment of intestinal tissues confirmed inflammation at all levels of the colon but not in the ileum. At 10 min post ILI, distal ileum tissues contained ~5-fold higher levels of hIL-10 for the delivery construct of SEQ ID NO: 5 compared to rhIL-10 treatment; in inflamed tissue hIL-10 levels measured after ILI of the delivery construct of SEQ ID NO: 5 were ~10-fold higher compared to rhIL-10 treatment (FIG. 128). The higher tissue levels of hIL-10 observed in the inflamed colon relative to non-inflamed distal ileum was likely due to differences in barrier properties of these tissues. Tissues examined at 40 min post ILI suggested that the hIL-10 delivered via the delivery construct of SEQ ID NO: 5 mirrored the data obtained at 10 min with a greater relative uptake being observed in the non-inflamed distal ileum (data not shown). Importantly, hIL-10 was not observed in the systemic circulation (FIG. 128).

Assays were conducted to ensure that the genetic construction of the delivery construct of SEQ ID NO: 5 retained the A-B transcytosis properties that should be imparted by the cholix derived carrier that involved receptor-mediated uptake and vesicular trafficking without targeting to the lysosomal degradation pathway in polarized enterocytes. The cholix derived carrier and hIL-10 elements of the fusion protein of the delivery construct of SEQ ID NO: 5 remained together during A-B transcytosis and within the lamina propria, allowing localization of hIL-10 to accurately describe the distribution of the delivery construct of SEQ ID NO: 5 (FIG. 129). While Rab7+ vesicles (defining late endosomes) were present in both apical and basal vesicular compartments of enterocytes, co-localization with the delivery construct occurred predominantly in the apical vesicular compartment (FIG. 130). Rab11+ vesicles defining recycling endosomes) were also observed in both the apical and basal compartments of enterocytes but, opposite to Rab7, co-localizations occurred mostly in the basal vesicular compartment (FIG. 131). The delivery construct of SEQ ID NO: 5 co-localized with Rab11 to a greater extent compared to Rab7 within cells in the lamina propria (FIGS. 130 and 131).

MAN1 (Lectin, Mannose Binding 1) protein, which is a resident of the endoplasmic reticulum-golgi intermediate compartment (ERGIC) and known to be involved in the sorting or recycling of proteins and lipids, has been shown to be involved in cholix transcytosis. The delivery construct of SEQ ID NO: 5 also co-localized with redistributing LMAN1 during A-B transcytosis (FIG. 132): at 1 min, when the delivery construct was just entering at the luminal membrane, LMAN1 was localized in the apical compartment; at 5 min, LMAN1 and some of the internalized the delivery construct of SEQ ID NO: 5 were present in the supranuclear region associated with ERGIC distribution; by 10 min the delivery construct of SEQ ID NO: 5 and LMAN1 were extensively co-localized in the basal compartment; and by 15 min the extent of LMAN1 redistribution and co-localization with the delivery construct of SEQ ID NO: 5 throughout the enterocyte was maximized. The timing of LMAN1 redistribution to the basal compartment coincides with the presence of hIL-10 being ultimately detected in non-polarized cells within the lamina propria where it was not associated with LMAN1. This re-distribution of LMAN1 associated with the delivery construct of SEQ ID NO: 5 A-B transcytosis is identical to that previously observed for cholix.

The A-B transcytosis pathway accessed by cholix has been shown to intersect with Rab7+ and LAMP1+ vesicles; while these are markers of both late endosomes and lysosomes, cholix does not appear to traffic to lysosome-like structures within enterocytes. To examine this point for the delivery construct of SEQ ID NO: 5, a time course of LAMP1 and the delivery construct co-localization was performed (FIG. 133). Limited LAMP1/delivery construct co-localizations were observed in polarized enterocytes at 1 min post ILI, with the extent of these not increasing over the 15 min time course required for completion of the delivery construct's A-B transcytosis. LAMP1+ structures in non-polarized cells within the lamina propria did not show co-localization with the delivery construct of SEQ ID NO: 5 at 1 min and 5 min post ILI. There were, however, extensive LAMP1/delivery construct co-localizations in non-polarized cells within the lamina propria at 10 min and 15 min post ILI. Together, these data suggest that the delivery construct of SEQ ID NO: 5's A-B transcytosis completed over a time course of 10-15 min and involved apical compartment Rab7+ vesicles, basal compartment Rab11+ vesicles, LMAN1 redistribution, and avoidance of lysosomal fate in enterocytes similar to that observed previously for cholix A-B transcytosis. Ultimately, the delivery construct is delivered to lysosome-like structures within a large fraction of cells within the lamina propria, an outcome that would limit its systemic distribution following A-B transcytosis.

Example 35: Macrophages in the Lamina Propria are Activated by the Delivery Construct of SEQ ID NO: 5

Figure 67:
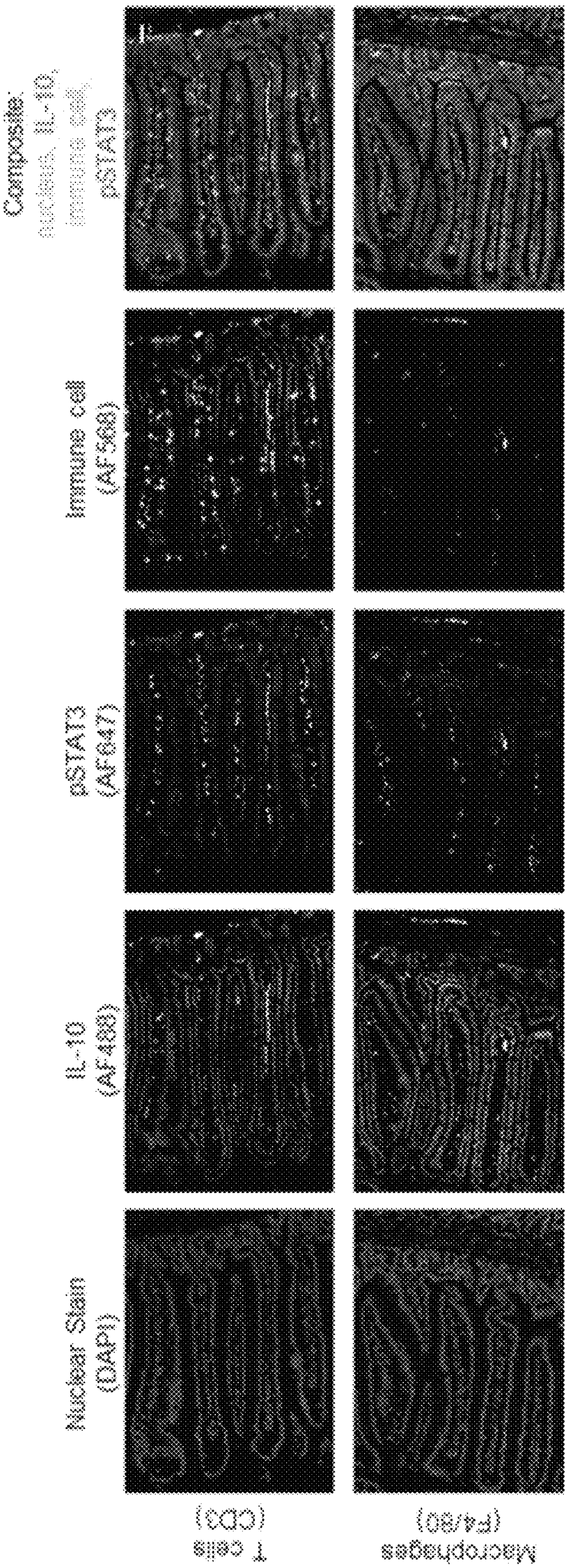
FIG. 67 illustrates cellular targeting of the IL-10 delivery construct to T cells and macrophages in the GI submucosa.

After determining that the delivery construct of SEQ ID NO: 5 was biologically active in vivo, the cellular target of the delivery construct was investigated using immunofluorescent microscopy. Demonstration of hIL-10 delivery to the lamina propria was shown in mouse jejunum tissue samples along with pSTAT3 induction and immune cell labeling (FIG. 67). At this 40 min time point after oral gavage, hIL-10 was observed in the basal region of enterocytes and in linear organizations within the lamina propria that were consistent with lacteals and/or vascular vessels. Areas adjacent to detected hIL-10 demonstrated strong pSTAT3 expression in many cells within the lamina propria and, to much lower levels, in some nuclei of polarized enterocytes. A moderate proportion of CD3+ cells within the lamina propria were observed to co-localize with pSTAT3: many CD3+ cells present within this compartment were not positive for pSTAT3 and there were many pSTAT3+ cells that were not positive for CD3 (FIG. 134). Using the macrophage-specific marker F4/80, however, we observed an extensive co-localization with pSTAT3 (FIGS. 135 and 136). Additional examples of F4/80 and pSTAT3 labeling are highlighted in tissue samples obtained from the small intestine (FIG. 137) and colon (FIG. 138) obtained following gavage dosing of the delivery construct of SEQ ID NO: 5 in mice that was consistent with extensive IL-10 activation of macrophage cell populations within the lamina propria. The results suggest that the delivery construct of SEQ ID NO: 5 ultimately targeted to CD3+T lymphocytes following A→B transcytosis, possibly through interactions driven by its cholix-derived carrier element, while macrophages were extensively targeted by the hIL-10 element.

Example 36: Circulating IL-1Ra and Systemic hIL-10 Increases in Response to Oral Gavage with the Delivery Construct of SEQ ID NO: 5 in Mice The inflammatory actions of IL-1β are modulated by the presence of a specific receptor antagonist known as IL-1Ra. Increased serum IL-1Ra levels can be induced by IL-10, which can occur in the absence of a pro-inflammatory state. With an appreciation of uncertainties associated with how much and when biologically active delivery construct is released from the stomach to reach the small intestine as well as the timing of its uptake and actions within the lamina propria following oral gavage, we examined IL-1Ra to function in non-inflamed mice as a biomarker of the IL-10 delivery construct's actions.

Oral gavage of 10 mg/kg of the delivery construct of SEQ ID NO: 5 resulted in ~50 pM hIL-10 being detected in systemic circulation as early as 1 h, which increased to ~700 pM at 4 h (FIG. 139). Detection of hIL-10 in distal small intestinal (FIG. 140) and colonic (FIG. 141) tissues were not significantly elevated above baseline at 1 and 2.5 h but showed slight increases with high variability at 4 h; hIL-10 in small intestinal lysates were ~10-fold higher than colonic lysates. Serum IL-1Ra levels were significantly increased at 4 h (FIG. 142). These results demonstrated that the onset of IL-1Ra induction occurs between 2.5-4 h post oral gavage, about the same time of a detectable increase in tissue levels of hIL-10 was observed in distal small intestinal and colonic tissues. This result suggests that either there was a nearly immediate induction of IL-1Ra following the uptake of the delivery construct in distal small intestinal and colonic tissues, or that this induction occurred several hours following the nearly rapid uptake of the delivery construct in the upper small intestine after oral gavage. To test this question, the delivery construct was directly deposited onto the luminal surface of colonic intestinal mucosa in a nonhuman primate model.

Example 37: Induction of IL-1Ra Following Intracolonic Spray with the Delivery Construct of SEQ ID NO: 5 in Nonhuman Primates (NHPs)

A topical spraying approach was used to administer 1, 3, or 10 mg (total dose) of the delivery construct of SEQ ID NO: 5 onto the luminal surface of colonic mucosae (proximal, mid, and distal) of healthy, fasted nonhuman primates (cynomolgus monkeys). This was achieved using a colonoscope with an associated spray nozzle. In this way, refined information for onset and duration of IL-1Ra induction could be obtained at specific local doses. Circulating levels of IL-1Ra increased between 2-3 h after colonic spray in a manner that suggested a near saturation of this response at the lowest dose tested (FIG. 147). Analysis of pSTAT3 induction in colon tissues biopsies showed the anticipated time course of onset and recovery to baseline for this event that correlated with ~15 min for the delivery construct of SEQ ID NO: 5 to reach the lamina propria following luminal application (FIG. 148). The variability of pSTAT3/total STAT3 detected was consistent with tissue capture and stability challenges in this in vivo model. Measurement of tissue delivery construct levels had similar tissue capture and stability challenges, showing low and variable amounts in the tissue samples collected (FIG. 143). Importantly, while the delivery construct of SEQ ID NO: 5 could be detected in colonic tissue, serum levels of the delivery construct were below the assay detection limit (FIG. 145), consistent with retention of this material in the intestinal lamina propria. Since IL-10 can induce cells to produce more IL-10, we also looked for induced IL-10. Within 15 min after an intracolonic spray with the delivery construct of SEQ ID NO: 5, dose-dependent and transient increases in tissue IL-10 levels were observed (FIG. 144). Serum levels of IL-10 were also increased in a dose-dependent manner to the amount of the delivery construct dosed by colonic spray (FIG. 146); these increased serum levels, while remaining in the picomolar range, were more durable than those observed in colonic tissue. It is important to note, due to the similarity of human and NHP IL-10, that ELISA values shown could also include hIL-10 that has somehow separated from the carrier domain of the delivery construct molecule. While this cannot be ruled out, no other data supports this as an outcome and it appears likely that the majority, if not all, tissue and serum IL-10 measured represents an NHP source.

Example 38: Salt Screening for Dimer Stability During Processing

A screen of various salts and salt concentrations was conducted to assess the stability of the IL-10 delivery construct (SEQ ID NO: 5) in various liquid media. Formulations were prepared with the delivery construct at 20 g/L in 10 mM Sodium Phosphate at pH 7.0 with the salts and salt concentrations as indicated in Table 53. The percentage of the IL-10 delivery construct present in dimer form, monomer form, and high molecular weight aggregates (HMW Agg) was assessed by size exclusion HPLC as indicated previously. Table 53 shows the results immediately after formulating and after a 2-day incubation at 25° C. Table 54 shows results for further salt concentrations at the initial time point Of the formulations assessed, 1×PBS, 150 mM, and 200 mM NaCl showed the most stability. Higher concentrations were considered for $Na_2SO_4$ and $NH_4SO_4$ (data not shown). However, the IL-10 delivery construct was seen to precipitate during buffer exchange.

TABLE 53

IL-10 delivery construct (SEQ ID NO: 5) dimer percentage in different salt formulations

| | t0 | | | 25 C., 2 days | | |
|---|---|---|---|---|---|---|
| Formulation | HMW Agg | Dimer | Monomer | HMW Agg | Dimer | Monomer |
| Starting material | 3.5 | 88.8 | 7.7 | 5.1 | 86.76 | 8.2 |
| NaCl 150 mM | 3.7 | 91.3 | 5.0 | 6.3 | 83.9 | 9.8 |
| NaCl 200 mM | 2.8 | 91.7 | 5.4 | 5.7 | 84.3 | 9.97 |
| NaCl 250 mM | 3.6 | 91.4 | 4.97 | 5.5 | 84.3 | 10.1 |
| KCl 50 mM | 3.5 | 91.6 | 4.9 | 7.0 | 84.1 | 8.9 |
| KCl 100 mM | 3.9 | 91.5 | 4.6 | 7.8 | 81.5 | 10.6 |

TABLE 53-continued

IL-10 delivery construct (SEQ ID NO: 5) dimer percentage in different salt formulations

| | t0 | | | 25 C., 2 days | | |
|---|---|---|---|---|---|---|
| Formulation | HMW Agg | Dimer | Monomer | HMW Agg | Dimer | Monomer |
| KCl 150 mM | 3.1 | 91.6 | 5.3 | 6.3 | 83.9 | 9.8 |
| $MgCl_2$ 25 mM | 9.6 | 85.6 | 4.8 | 40.8 | 52.8 | 6.4 |
| $MgCl_2$ 50 mM | 8.5 | 87.2 | 4.3 | 31.9 | 60.5 | 7.5 |
| $MgCl_2$ 75 mM | 7.2 | 86.2 | 6.6 | 23.0 | 67.9 | 9.0 |
| $Na_2SO_4$ 250 mM | 3.3 | 90.9 | 5.7 | 5.0 | 82.5 | 12.5 |
| $Na_2SO_4$ 500 mM | 4.2 | 90.9 | 4.9 | 6.7 | 83.4 | 9.9 |
| $NH_4SO_4$ 250 mM | 3.2 | 89.6 | 7.1 | 6.1 | 79.6 | 14.3 |
| $NH_4SO_4$ 500 mM | 3.5 | 89.7 | 6.8 | 8.5 | 74.1 | 17.4 |

TABLE 54

IL-10 delivery construct (SEQ ID NO: 5) dimer percentage in different salt formulations

| Buffer | Salt | Concentration | HMW Agg | Dimer | Monomer |
|---|---|---|---|---|---|
| | starting material | | 3.1 | 92.3 | 4.6 |
| 10 mM Sodium Phosphate | NaCl | 150 mM | 3.3 | 91.8 | 4.9 |
| | | 500 mM | 2.7 | 92.0 | 5.2 |
| | | 1M | 2.8 | 91.6 | 5.6 |
| | $Na_2SO_4$ | 25 mM | 3.1 | 91.7 | 5.2 |
| | | 50 mM | 2.9 | 91.9 | 5.1 |
| | | 75 mM | 3.4 | 91.4 | 5.2 |
| | $NH_4SO_4$ | 25 mM | 4.1 | 90.5 | 5.4 |
| | | 50 mM | 2.9 | 91.9 | 5.2 |
| | | 75 mM | 3.2 | 91.5 | 5.3 |
| | | 100 mM | 3.2 | 91.0 | 5.8 |

Example 39: Comparison of Different Purification Conditions with S-650F Cation Exchange Columns for an IL-10 Delivery a Construct IL-10 delivery construct (SEQ ID NO: 5) was purified from inclusion bodies using a process analogous to that described in FIG. 2B. Refolding was carried out at 4° C. in a refolding solution containing 1 mM reduced glutathione, 0.5 mM oxidized glutathione, 1M Arginine-HC, 250 mM sucrose, 100 mM Tris pH 8.5 at 4° C., and 2 mM EDTA. IL-10 delivery construct (SEQ ID NO: 5) was purified using each of the three process trains described in Tables 55-57. Buffer A for the CHT bind/elute step in Table 56 may also comprise 25 mM Tris, pH7.5, 300 mM NaCl, 5.0 mM NaPi, 0.5 mM CaCl2. Columns used are described in Table 58.

TABLE 55

| Process train 1 | | | | | | |
|---|---|---|---|---|---|---|
| Column | Buffer A | Buffer B | Sample prep | Column equilibration | Column wash | Elution |
| Capto Q ImpRes | 25 mM Tris pH7.5 | 25 mM Tris pH7.5, 1M NaCl | 2xUFDF (25 mM Tris pH7.5, 150 mM NaCl) | 15% B | 15% B | 15-40% B, 16 CV |
| S-650F | 20 mM NaPi pH7.0 | 20 mM NaPi pH7.0, 1M NaCl | 1/1 Dilution with 40 mM NaPi pH7.0 | 20% B | 20% B | 20-45% B, 10 CV |
| CHT (FT-mode) | 80 mM NaPi pH7.0 | 200 mM NaPi pH7.0 | Add 1M NaPi pH7.0 to a final of 60 mM (X L x 0.0417) | 0% B | 100% B | FT-mode |

TABLE 56

| Process train 2 | | | | | | |
|---|---|---|---|---|---|---|
| Column | Buffer A | Buffer B | Sample prep | Column equilibration | Column wash | Elution |
| Capto Q ImpRes | 25 mM Tris pH7.5 | 25 mM Tris pH7.5, 1M NaCl | 2xUFDF (25 mM Tris pH7.5, 150 mM NaCl) | 15% B | 15% B | 15-40% B, 16 CV gradient elution |
| CHT (Bind/Elute) | 25 mM Tris pH7.5, 150 mM NaCl | 200 mM NaPi pH7.0 | none | 0% B | 0% B | 30% B 2CV Step elution |
| S-650F | 20 mM NaPi pH7.0 | 20 mM NaPi pH7.0, 1M NaCl | Dilute 1:1 with water | 20% B | 20% B | 20-45% B, 10 CV gradient elution |

TABLE 57

| Process train 3 | | | | | | |
|---|---|---|---|---|---|---|
| Column | Buffer A | Buffer B | Sample prep | Column equilibration | Column wash | Elution |
| S-650F | 20 mM NaPi pH7.0 | 20 mM NaPi pH7.0, 1M NaCl | 2xUFDF (NaPi pH7.0, 200 mM) | 20% B | 20% B | Step gradient (45% B), 2-3 CV |
| Capto Q ImpRes | 25 mM Tris pH7.5 | 25 mM Tris pH7.5, 1M NaCl | Dilute 1/2 with 75 mM Tris pH7.5 | 15% B | 15% B | 15-40% B, 16 CV |
| CHT (FT-mode) | 40 mM NaPi pH7.0 | 200 mM NaPi pH7.0 | Add 1M NaPi pH7.0 to a final of 60 mM (X L x 0.064) | 0% B | 100% B | FT-mode |

TABLE 58

| Columns | | | |
|---|---|---|---|
| Column | DBC | Starting amount (5 L refold) | Column volume |
| Capto Q ImpRes | 16 g/L | 5 g (20 cm h) | 320 mL |
| S-650F | 20 g/L | 200 mg (20 cm h) | 41 mL |
| CHT | 20 g/L | 200 mg (20 cm h) | 106 mL |

The yield, recovery, and purity of the IL-10 delivery construct was assess after each step, and after each process train. Table 59 shows a comparison between process train 2 and a control process.

TABLE 59

| comparison between process train 2 (PT2) and control | | | | |
|---|---|---|---|---|
| Name | Process | Yield | Purity | Recovery |
| PT2 | Capto Q ImpRes CHT step B/E 80 mM NaPi S-650F | 26 mg | 78.5% | 1% |
| Control | Capto Q ImpRes CHT gradient B/E | 68 mg | 78.2 | 1.5% |

TABLE 60

| comparison of different process trains | | | | |
|---|---|---|---|---|
| Process Train | Chromatography | Purity | Recovery | Endotoxin |
| Control* | Capto Q CHT (Linear elution) | *85% | — | *8 EU/mg |
| PT1 | Capto Q S-650F CHT (FT mode) | 92% | 24% | 8.9 EU/mg |
| PT2 | Capto Q CHT (Step elution) S-650F | 91% | 24% | 5 EU/mg |
| PT3 | S-650F Capto Q CHT (FT mode) | 96% | 20% | 0.4 EU/mg |

*Based on historical data

Table 60 shows a comparison of the three different process trains, and a control process train without an S-650F column. All three process trains with S-650F cation exchange column purifications resulted in higher purity of the IL-10 delivery construct. Process trains 2 and 3 resulted in lower levels of endotoxin than the control process. It was surprising that a cation exchange resin was useful in the purification of the IL-10 delivery construct as cation exchange resins are negatively charged, and thus bind to proteins with a positive charge. Here, the IL-10 delivery construct has a calculated isoelectric point (pI) of 5.49, and thus is anticipated to have a negative charge under conditions traditionally used in a cation exchange chromatography. Surprisingly, however, the IL-10 delivery construct bound to the cation exchange resin.

A possible explanation for the IL-10 delivery construct binding to the Sulfate-650F resin is that, while the calculated pI for the IL-10 delivery construct is 5.49, each domain (cholix and IL-10) maintains its own unique properties and has a local pI that differs significantly from the pI of the overall construct. For instance, the calculated pI of IL-10 is 8.1 and under working conditions (e.g., pH 7) the IL-10 delivery construct would have a positively charged IL-10 domain that binds to the cation exchange resin.

Example 40: A Randomized Double-Blind Placebo Controlled Exploratory Medicine Trial in Adults with Active Rheumatoid Arthritis Who have Demonstrated an Inadequate (Partial) Response to Anti-TNF Therapy IL-10 is considered a master regulator of the innate and adaptive immune system as it inhibits not only the inflammasome but many inflammatory events found to be associated with RA beginning with macrophage activation and secretion of IL-1, IL-6, TNF alpha, MMP-1/2 while reducing systemic signs of inflammation and development of T regulatory cells.

Oral delivery of an IL-10 delivery construct provides local delivery of IL-10 to the GI mucosal immune system while avoiding high systemic levels of the drug. Providing local delivery of IL-10 to the GI mucosa may also be able to effect systemic immunoregulation. Modulation of immune cell activity as the immune cells traffic through the GI mucosa may result in effective systemic immunoregulation as those cells then move throughout the body. Thus, targeted delivery of IL-10 to the GI mucosal immune system may be able to cause effective immunoregulation for treatment of, for example, rheumatoid arthritis subjects with enhanced safety.

This study assesses the safety and tolerability of 12 weeks of daily oral IL-10 via an IL-10 delivery construct in subjects with active rheumatoid arthritis who have demonstrated only a partial response to TNF inhibitors. The study also assesses the biologic activity of 12 weeks of daily oral treatment with an IL-10 delivery construct by changes in the Disease Activity Score 28 (DAS-28) (CRF), Simplified Disease Activity Index (SDAI) and Clinical Disease Activity Index (CDAI). Additionally, the study examines the pharmacokinetic and pharmacodynamic effects of the IL-10 delivery construct and to examine the immunogenicity of the IL-10 delivery construct. The study also evaluates quality of life (QOL) with Health Assessment Questionnaire without Didability Index (HAQ-DI ) after 12 weeks of daily oral IL-10 via the IL-10 delivery construct.

This is a randomized double-blind placebo-controlled study in approximately 18 subjects with active Rheumatoid Arthritis who had an inadequate (partial) response to anti-TNF therapy. Subjects are randomized in 2:1 ratio to receive either the IL-10 delivery construct or placebo for 12 weeks. The study population comprises adult subjects with active Rheumatoid Arthritis who had an inadequate (partial) response to anti TNF therapy.

Subjects are included in the study if they fit the following inclusion criteria. Subjects are aged ≥18 and <75 years old at the time of informed consent. Subjects have a diagnosis of rheumatoid arthritis (RA) under the 1987 American College of Rheumatology (ACR) or 2010 ACR/European League Against Rheumatism (EULAR) criteria. Subjects have received anti TNF biologic treatment under approved dosage and administration for ≥12 weeks but only had a partial response. A history of biologics treatment should be limited to 1 or 2 anti TNF agents among adalimumab, infliximab, golimumab, etanercept, (including biosimilars). Subjects have at least one joint showing active disease by MRI/FOI and two or more tender joints (out of 28 joints) and 2 or more swollen joints in the Screening Phase. Subjects are able to continue stable dose regimen of anti-TNF until completion or until study discontinuation. Subjects have a C-reactive protein (CRP) level ≥0.6 mg/deciliter (dL) or erythrocyte sedimentation rate (ESR) ≥28 millimeters per hour (mm/hr.) in the Screening Phase. Subjects have a weight of ≥30 kilograms (kg) and ≤100 kg. Subjects are required to voluntarily consent, in writing, to participate in this study. All subjects are thoroughly briefed on the conditions for participation in the study, is able to understand, and must be willing and able to comply with all aspects of the protocol.

Subjects are excluded from the study if they have any medical history which may suggest increased risk or possible confounding factors. Subjects are excluded from the study if they have an inflammatory arthritic disorder other than rheumatoid arthritis or Sjogren's syndrome, or if they are diagnosed with rheumatoid arthritis class IV (according to ACR 1991 Revised Criteria for the Classification of Global Functional Status). Subjects are also excluded if they have recently received an immunoglobulin preparation, blood products or a live vaccine. Subjects are excluded from this study if they have a history of severe allergy (shock or anaphylactoid symptoms). Subjects are also excluded if they have a history of, or current condition of, cancer, or immunodeficiency. Subjects with a history of, or current, infectious disease may also be excluded. Subjects must not be pregnant or lactating, and must agree to use a highly effective method of contraception for the duration, and for some time after, the trial. Subjects are excluded from this study if they have any history of a medical condition or a concomitant medical condition that in the opinion of the investigator or sub-investigator would compromise the participant's ability to safely complete the study Outcome Measures Subjects are monitored clinically, including by physical exams, hematology, chemistry, EKG, and urinalysis. Clinical efficacy is assessed by several different measures. Disease Activity Score 28 (DAS-28) is a mathematically calculated, continuous, composite endpoint with differential weighting given to each of the following components: tender joint count (28 joints), swollen joint count (28 joints), acute phase reactant, and patient global assessment of arthritis. Simplified Disease Activity Index (SDAI) measures the number of swollen and tender joints (shoulder, elbow, wrist, metacarpal phalangeal joints and proximal phalangeal joints of the hand), Patient and Physician global assessments of Disease Activity and CRP. CDAI is the same as SDAI but omits the CRP value. HAQ-DI assesses the degree of difficulty a patient has experienced during the past week in eight domains of daily living activities: dressing and grooming, arising, eating, walking, hygiene, reach, grip, and other activities. DAS28 (case report form), SDAI and CDAI, are all assessed at baseline, weeks 2, 4 8; and 12; Health Assessment Questionnaire-Disability Index (HAQ-DI) to assess physical function changes will be assessed at baseline and weeks 4, 8, 12 and 16 (4 weeks after last dose).

Serum levels of the IL-10 delivery construct and IL-10 are assessed at baseline and Day 1 at 4, 8 and 24 hrs. post dose and at weeks 2, 4, 8, 12 and 16.

Pharmacodynamic markers that are assessed include monocyte HLA-DR expression; serum IL-1Ra, CRP, Serum Amyloid A, VCAM-1, IL-1, IL-6, TNF alpha, MMP1/2, ESR, EGF and VEGF-alpha: obtained at baseline and Day 1-at 24 hrs. and weeks 2, 4, 8 12 and 16. The total/titer of anti-IL-10 delivery construct levels is assessed at weeks 12 and 16.

Subject safety will be monitored and subjects are removed from the study if they experience adverse events or serious adverse events, or clinically significant laboratory changes.

Treatment efficacy is considered both in terms of change over time, and at completion of therapy and 4 weeks post completion in:

1. DAS-28(case report form), SDAI and CDAI;
2. Proportion of subjects with DAS-28 less than 2.6;
3. HAQ-DI compared to baseline; and
4. Change in acute phase reactants (CRF, ESR).

Changes in the IL-10 delivery construct and serum IL-10 levels compared to baseline: Day 1-8 and 24 hrs. and at weeks 2, 4, 8 and 12 is plotted and considered. Changes in biomarkers are compared to baseline for monocyte HLA-DR expression, serum IL-1Ra, Serum Amyloid A, VCAM-1, IL-1, IL-6, TNF alpha, MMP1/2, EGF and VEGF-alpha: baseline and Day 1—at 8 and 24 hrs. and weeks 2, 4, 8 and 12. The incidence of anti-drug antibodies at weeks 12 and 16 is compared to baseline. A positive outcome may be an incremental benefit in any of the abovementioned parameters with the combination therapy as compared to the TNF alpha inhibitor alone.

Example 41: Exploratory Medical Trial-Ulcerative Colitis TNF Partial Responders This study aims to evaluate the efficacy and safety of an IL-10 delivery construct in patients with moderate to severe active ulcerative colitis who are partial responders to anti-Tumor Necrosis Factor α antibody treatments.

This study assesses the safety and tolerability of 12 weeks of daily IL-10 via an oral IL-10 delivery construct in subjects with moderate to severe ulcerative colitis who have demonstrated only a partial response to TNF monoclonal antibody inhibitors. The study also assesses the clinical activity of 12 weeks of daily IL-10 via an oral IL-10 delivery construct by changes in the Modified Mayo Score, MMS subscales and histopathology. This study examines the pharmacokinetic and pharmacodynamic effects of the IL-10 delivery construct, as well as it's immunogenicity.

This is an open label study in approximately 12 subjects with moderate to severe Ulcerative Colitis who had an inadequate (partial) response to anti-TNF therapy. Subjects receive an IL-10 delivery construct corresponding to the amino acid sequence of SEQ ID NO: 5 for 12 weeks while continuing their stable dose of anti-TNF therapy and are followed for safety for an additional 4 weeks.

The study population is drawn from adult subjects with active moderate to severe Ulcerative Colitis (Modified Mayo Score of 4-9 excluding GPA and with a central read Mayo endoscopic sub score of 2 or 3) who had an inadequate (partial) response to anti-TNF monoclonal antibody therapy.

Potential subjects are assessed by the following eligibility criteria. For inclusion all patients must provide written informed consent; and be between 18-75 years.

Subjects have a diagnosis of UC according to American College of Gastroenterology guidelines. Subjects have moderate-to-severe active UC, at time of screening, defined as: Modified Mayo Clinic Score (MMS) of between 4-9 points AND a centrally read MCS endoscopic sub score of grade 2 or higher, AND MMS rectal bleeding sub score of 1 point or higher, AND disease extending 15 cm or more from the anal verge. Stable doses of allowed concomitant medications include: stable oral corticosteroids (i.e., ≤20 mg/day of prednisone, ≤9 mg/day of budesonide) ≥2 weeks before D1 dosing; tapering of oral corticosteroids per Investigator's discretion during the study is allowed; stable oral 5-amyinosalicylic acid dose ≥2 weeks before D1 dosing; stable doses of probiotics ≥2 weeks before D1 dosing; and stable anti-diarrheas ≥2 weeks before D1 dosing. Patients must be receiving anti-tumor necrosis factor alpha therapy for UC and have demonstrated an inadequate (partial) response before D1 dosing or must be naïve to anti-TNF therapy prior to screening; allowed anti-TNFs include Infliximab (Remicade), adalimumab (humira) and golimumab (Simponi) but excluding etanercept Patients previously treated with cyclosporine or tacrolimus must have discontinued therapy ≥4 weeks before D1 dosing. Topical corticosteroids and topical 5-amyinosalicylic acid preparations must have been withdrawn ≥2 weeks before D1 dosing. Nonsteroidal anti-inflammatory drugs (NSAIDs) must have been discontinued ≥4 weeks before D1 dosing. Tofacitinib or other Janus kinase (JAK) inhibitors must have been discontinued >2 weeks before D1 dosing. Females with reproductive potential must have a negative pregnancy test result before enrollment. Men and women with reproductive potential have to be willing to use a highly effective method of contraception from study start to ≥3 months after the final dose of the study drug. A highly effective method of birth control is defined as one which results in a low failure rate (less than 1% per year).

Subjects are excluded from this study if they have any of the following GI related exclusion criteria: indeterminate colitis (IBD-U) or suspected Crohn's disease, any history of colectomy, presence of an ileostomy or colostomy, a history or evidence of colonic mucosal dysplasia or short gut syndrome.

Subjects are excluded from this study if they have any of the following general health related exclusion criteria: pregnant or lactating, inability to comply with study protocol in the opinion of the investigator, history of dysplasia or malignancy in recent 5 years, except completely excised basal cell carcinoma or squamous cell carcinoma of the skin or carcinoma in situ of the cervix, cirrhosis or active alcohol abuse per the judgement of investigator, poorly controlled diabetes (HbAlc >8.0%), significant screening ECG abnormalities, or impaired renal function.. Subjects with evidence of current or previous clinically significant disease, medical condition or finding in the medical examination that in the opinion of the investigator, would compromise the safety of the patient or quality of the data are excluded from this study.

Subjects are monitored clinically, including by physical exams, hematology, chemistry, EKG, and urinalysis. Clinical efficacy is assessed by several different measures. The proportion of patients with clinical remission at week 12 is assessed. Clinical remission is defined as an endoscopic sub score of 0/1, a rectal bleeding sub score of 0, and a stool frequency sub score of 0 or 1 with at least a 1-point reduction from baseline. Clinical remission may also be defined as: stool frequency=0; stool bleeding=0; endoscopy score of 0 or 1 stool frequency sub score can also be at least 1-point decrease in stool frequency sub score from baseline (start of trial) to achieve a stool frequency sub score=0 or 1.

The proportion of patients with endoscopic response is assessed. Endoscopic response is defined as a Modified Mayo Clinical Score endoscopic subscale score of 0 or 1. Changes of histological activity grade from baseline using the Geboes or Robarts Histopathology Index system will be assessed. Histological healing is defined as histological grade=0.

Serum levels of the IL-10 delivery construct and IL-10 are assessed at baseline and at Day 1, weeks 2, 4, 8 and 12.

Pharmacodynamic endpoints which are assessed include monocyte HLA-DR expression; serum IL-1Ra, CRP, ESR, fecal calprotectin changes, IL-1, IL-6, TNF alpha, MMP1/2, and IFNg obtained at baseline and Day 1 and weeks 2, 4, 8, 12 and 16.

The total/titer of anti-IL-10 delivery construct levels is assessed at baseline and weeks 8, 12 and 16. Biopsies of colon at baseline and at end of treatment phase examined by light microscopy, immunohistochemistry, flow cytometry and gene arrays.

Subject safety is monitored, and subjects are removed from the study if they experience adverse events or serious adverse events, or clinically significant laboratory changes.

Treatment efficacy is considered both in terms of change over time, and at 4, 8 and 12 weeks and 4 weeks post completion in:

1. Change in Modified Mayo Score;
2. Change in Stool Bleeding subscale;
3. Change in Stool Frequency subscale;
4. Change in endoscopy subscale;
5. Change in acute phase reactants (CRF, ESR); and
6. Change in histopathology score (Geboes or Robarts).

Changes in the IL-10 delivery construct and serum IL-10 levels compared to baseline: Day 1-8 and 24 hrs and at weeks 2, 4, 8 and 12 are plotted and considered. Changes in biomarkers compared to baseline are considered for: monocyte HLA-DR expression serum IL-1Ra, IL-1, IL-6, TNF alpha, MMP1/2, EGF and VEGF-alpha at baseline and Day 1—at 8 and 24 hrs. and weeks 2, 4, 8 and 12. The incidence of anti-drug antibodies at weeks 12 and 16 is compared to baseline. Specific stains will be used to visualize infiltrating inflammatory cells and HLA-DR expression in colonic epithelium by Immunochemistry and/or flow cytometry and gene array. A positive outcome may be an incremental benefit in any of the abovementioned parameters with the combination therapy as compared to the TNF alpha inhibitor alone.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (156 sequences)

SEQ ID NO: 1 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 2 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 3 - protein, 634 aa, Artificial Sequence
  Description of Artificial Sequence: Synthetic polypeptide
VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 4 - protein, 386 aa, Artificial Sequence
  Description of Artificial Sequence: Synthetic polypeptide
VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQA

SEQ ID NO: 5 - protein, 561 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAGGGGSGGGGSGGGGSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 6 - protein, 14 aa, Artificial Sequence
  Description of Artificial Sequence: Synthetic peptide
GGGGSGGGGSGGGG

SEQ ID NO: 7 - protein, 60 aa, Artificial Sequence
  Description of Artificial Sequence: Synthetic polypeptide
  MISC_FEATURE (1)..(60): This sequence may encompass 1-15 "Gly Gly Gly Ser" repeating units
GGGSGGGSGGGSGGGSGGGSGGGSGGGSGGGSGGGSGGGSGGGSGGGSGGGSGGGSGGGS

SEQ ID NO: 8 - protein, 75 aa, Artificial Sequence
  Description of Artificial Sequence: Synthetic polypeptide
  MISC_FEATURE (1)..(75): This sequence may encompass 1-15 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGS

SEQ ID NO: 9 - protein, 90 aa, Artificial Sequence
  Description of Artificial Sequence: Synthetic polypeptide
  MISC_FEATURE (1)..(90): This sequence may encompass 1-15 "Gly Gly Gly Gly Gly Ser" repeating units
GGGGGSGGGGGSGGGGGSGGGGGSGGGGGSGGGGGSGGGGGSGGGGGSGGGGGSGGGGGSGGGGGSGGGGGSGGGGGSGGGGGSGGGGGS

SEQ ID NO: 10 - DNA, 1683 bp, Artificial Sequence
  Description of Artificial Sequence: Synthetic polynucleotide
atggtagaagaagcgctgaatatttttgacgagtgtcgtagcccgtgtagcctgactccggaaccgggcaagccgattcagtccaaactgtctatcccgagcgacgttgtgctggatgagggcgtgttgtattacagcatgacgatcaatgatgagcaaaacgacatcaaagacgaagataagggtgagtctattatcaccattggcgagtttgcgacggtgcgtgcaacgcgccattacgtgaatcaagacgcgccgtttggtgtcattcacctggatatcacgaccgaaaatggcacgaaaacctattcgtataatcgcaaagagggcgagttcgcgatcaactggctggttccgatcggtgaggatagcccggcgagcatcaagatcagcgttgatgaactggatcagcagcgcaacattattgaagtcccgaagttgtatagcatcgacctggataatcagaccctggagcagtggaaaacccagggtaacgttagcttctccgtgacccgtccggagcacaacattgccattagctggccgagcgttagctacaaagccgcacagaaagagggttcccgccacaagcgttgggctcattggcataccggtttggcgctgtgttggctggtgccgatggatgcgatctataactacatcacgcagcaaaattgcacgctgggtgacaattggttcggtggcagctacgagactgtggcgggtacccctaaggttattaccgtcaaacagggtattgagcaaaagcctgtcgagcagcgtatccactttagcaagggtaacgccatgtctgctctggcggctcatagagtttgcggcgttccgctggagactctggcccgttcccgcaagccgcgtgacctgaccgatgacctgagctgcgcgtatcaagcgcaaaacattgttagcttattcgttgcgacgcgcattttgttttcgcacctggatagcgtgttcacgctgaacctggatgaacaggaaccagaagtggcagagcgtctgtcagatctgcgtcgtatcaacgaaaacaacccgggcatggttacccaggtccttacggttgcacgccagatttacaatgattacgtgacccatcacccgggtctgaccccagaacaaaccagcgcaggcgcacaagcgggtggcggtggttccggtggcggtggtagcggtggcggtggtagccctggtcaaggcacccaatccgagaatagctgcacgcattttccaggcaatctgccgaatatgctgcgtgacctccgcgacgcgttctctcgtgttaagaccttttttcagatgaaagaccagctggacaatctgctgctgaaagaatccctgctggaagatttcaaaggctatctgggttgccaggccctgagcgagatgatccaattctacttggaagaggtcatgccgcaggccgaaaatcaagacccggacatcaaggcacacgtgaacagcttgggcgaaaacctgaaaaccctgcgtttgcgcctgcgtcgttgtcaccgtttcctgccgtgcgagaataagagcaaagccgtcgaacaagtcaaaaatgcattcaacaagctgcaagagaaaggtatctacaaggctatgagcgagtttgacattttcattaactacattgaagcgtacatgaccatgaagatccgtaac

SEQ ID NO: 11 - protein, 634 aa, Artificial Sequence
  Description of Artificial Sequence: Synthetic polypeptide
LEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 12 - protein, 386 aa, Artificial Sequence
  Description of Artificial Sequence: Synthetic polypeptide
LEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQA

SEQ ID NO: 13 - protein, 561 aa, Artificial Sequence
  Description of Artificial Sequence: Synthetic polypeptide
MLEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAGGGGSGGGGSGGGGSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 14 - DNA, 22 bp, Artificial Sequence
  Description of Artificial Sequence: Synthetic primer
gctcattgctgggtacttacaa

SEQ ID NO: 15 - DNA, 21 bp, Artificial Sequence
  Description of Artificial Sequence: Synthetic primer
ccagacttggcacaagacagg

SEQ ID NO: 16 - DNA, 20 bp, Artificial Sequence
  Description of Artificial Sequence: Synthetic primer
cacagcagcacatcaacaag

SEQ ID NO: 17 - DNA, 20 bp, Artificial Sequence
  Description of Artificial Sequence: Synthetic primer
gtgctcatgtcctcatcctg

SEQ ID NO: 18 - DNA, 20 bp, Artificial Sequence
  Description of Artificial Sequence: Synthetic primer
tgtgtccgtcgtggatctga

SEQ ID NO: 19 - DNA, 21 bp, Artificial Sequence
  Description of Artificial Sequence: Synthetic primer
cctgcttcaccaccttcttga

SEQ ID NO: 20 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVALNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 21 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQAPEVAERLSALRQINENNPGVVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 22 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITDVIGHSLPLRNEAFTGPESAGGEDETVIGWDMAIHAVAIPSTIPGNAYEELAIDEEAVAKEQSISAKPPYKEQKDELK

SEQ ID NO: 23 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAIMVKQGIEQKPVEQRIHFSKKNAMEALAAHRVCGVPLETLARSRKPRYLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISPKPPYKERKDELK

SEQ ID NO: 24 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKDGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSAIRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 25 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKDGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKHCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 26 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWRTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 27 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSNGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 28 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLLENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 29 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQKNCTLGDNWFGGSYETVAGTPKVITVKQGIEQKPVEQRIHFSKGNAMSALAAHRVCGVPLETLARSRKPRDLPDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 30 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIYAVAIPSTIPGNAYEELAIDEEAVAKEQSISAKPPYKEQKDELK

SEQ ID NO: 31 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 32 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIYAVAIPSTIPGNAYEELAIDEEAVAKEQSISAKPPYKEQKDELK

SEQ ID NO: 33 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPMDAIYNYITQKNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 34 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISTKPPYKERKDELK

SEQ ID NO: 35 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITDVIGHSLPLRNEAFTGPESAGGEDETVIGWDMAIHAVAIPSTIPGNAYEELAIDEEAVAKEQSISAKPPYKEQKDELK

SEQ ID NO: 36 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAIHWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 37 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATIRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 38 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITFGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 39 - protein, 634 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 40 - protein, 634 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 41 - protein, 634 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 42 - protein, 634 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQNIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 43 - protein, 634 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDIAIHAVAIPSTIPGNAYEELAIDEEAVAKEQSISTKPPYKERKDELK

SEQ ID NO: 44 - protein, 634 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 45 - protein, 634 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMETLAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 46 - protein, 634 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 47 - protein, 634 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMETLAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 48 - protein, 634 aa, Unknown
  Description of Unknown: Cholix sequence
VEDELNIFDECRSPCLLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 49 - protein, 634 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVIPGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMETLAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 50 - protein, 633 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKERKDELK

SEQ ID NO: 51 - protein, 633 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSQKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 52 - protein, 633 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKERKDELK

SEQ ID NO: 53 - protein, 633 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 54 - protein, 633 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 55 - protein, 633 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGIPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKERKDELK

SEQ ID NO: 56 - protein, 633 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGIPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 57 - protein, 633 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 58 - protein, 633 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAQKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGGVYVATHAELAHRYARIKEGTGENGLPTTEEKKSRGVMLRVYLPRASLERFYRTNIPLENADEHVTQVIGHPLPLRNEAFTGPESAGGEDETAIGWDMAIHGVAIPSTIPGNSYAQLPIDEEAVAKEQSISAKPPYKEHDELK

SEQ ID NO: 59 - protein, 633 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAQKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGGVYVATHAEVNHRYARIKEGTGENGLPTTEEKKSRGVMLRVYLPRASLERFYRTNIPLENADEHVTQVIGHPLPLRNEAFTGPESAGGEDETAIGWDMAIHGVAIPSTIPGNSYAQLPIDEEAVAKEQSISAKPPYKEHDELK

SEQ ID NO: 60 - protein, 633 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAQKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGGVYVATHAELAHRYARIKEGTGENGLPTTEKKKSRGVMLKVYLPRASLERFYRTNIPLENADEHVTQVIGHPLPLRNEAFTGPESAGGENETAIGWDMAIHGVAIPSTIPGNSYAQLPIDEEAVAKEQSISAKPPYKEHDELK

SEQ ID NO: 61 - protein, 633 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 62 - protein, 633 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVIPGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKERKDELK

SEQ ID NO: 63 - protein, 633 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVIPGEDSPASIKISIDELDQQRNIIEVPKLYSIDLDNQTLEQWETQGNVSFAVTRPEQSIAISWPSVSYKAAQKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGGVYVATHAELAHRYARIKEGTGENGLPTTEEKKSRGVMLRVYLPRASLERFYRTNIPLENADEHVTQVIGHPLPLRNEAFTGPESAGGEDETAIGWDMAIHGVAIPSTIPGNSYAQLPIDEEAVAKEQSISAKPPYKEHDELK

SEQ ID NO: 64 - protein, 628 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 65 - protein, 628 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 66 - protein, 628 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEQSIAISWPSVSYNAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 67 - protein, 628 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 68 - protein, 628 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISTKPPYKERKDELK

SEQ ID NO: 69 - protein, 628 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKMYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISTKPPYKERKDELK

SEQ ID NO: 70 - protein, 628 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQKRNIIEVPKLYSIDLDNQTLEQWENQGNVSFAVTRPEQSIAISWPSVSYKAAHKNGSRHKRWANWLTTLPKVVLCFYEEPELCTYGEDWHGGAYKTVAGTPEAITVKQGIEQKTVEQRIHFSKKNAMEALAAHRVCGVPLETLARSRKPRDLQDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 71 - protein, 628 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 72 - protein, 628 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPLLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 73 - protein, 628 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVNQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 74 - protein, 628 aa, Unknown
  Description of Unknown: Cholix sequence
VEDELNIFDECRSPCSLTPEPGKPIQSKLFIPGDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAIEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 75 - protein, 628 aa, Unknown
  Description of Unknown: Cholix sequence
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWYGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDTDKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 76 - protein, 628 aa, Unknown
  Description of Unknown: Cholix sequence
VEDELKIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 77 - protein, 628 aa, Unknown
  Description of Unknown: Cholix sequence
VEDELKIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQAPEVAERLSDLRRINEDNPGMVTQVLTVARQIYNDYVTHHPGLTPEQTSAGAQAADILSLFCPDADKSCVASNNDQANINIESRSGRSYLPENRAVITPQGVTNWTYQELETTHQALTREGYVFVGYHGTNHVAAQTIVNRIAPVPRGNNTENEEKWGGLYVATHAEVAHGYARIKEGTGEYGLPTRAERETRGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 78 - protein, 628 aa, Unknown
  Description of Unknown: Cholix sequence
VEDELKIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKAVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIYAVAIPSTIPGNAYEELAIDEEAVAKEQSISAKPPYKEQKDELK

SEQ ID NO: 79 - protein, 617 aa, Unknown
  Description of Unknown: Cholix sequence
TPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 80 - protein, 605 aa, Unknown
  Description of Unknown: Cholix sequence
SIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 81 - protein, 594 aa, Unknown
  Description of Unknown: Cholix sequence
MTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 82 - protein, 588 aa, Unknown
  Description of Unknown: Cholix sequence
CSLTPEPGKPIQSKLSIPSDVVLDEGVLYYSMTINDEQNDIMDEGKGESIITIGEFATVRATRHYVNQDAPFGVINLDITTENGTKTYSYNRKEGEFTINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETIIGWDMAIHAVAIPS

SEQ ID NO: 83 - protein, 588 aa, Unknown
  Description of Unknown: Cholix sequence
CSLTPEPGKPIQSKLSIPSDVVLDEGVLYYSMTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPMDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 84 - protein, 588 aa, Unknown
  Description of Unknown: Cholix sequence
CSLTPEPGKPIQSKLSIPSDVVLDEGVLYYSMTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 85 - protein, 583 aa, Unknown
  Description of Unknown: Cholix sequence
MTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKAVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIYAVAIPSTIPGNAYEELAIDEEAVAKEQSISAKPPYKEQKDELK

SEQ ID NO: 86 - protein, 583 aa, Unknown
  Description of Unknown: Cholix sequence
MTINDEQNDIKDEDKGESIITIGDFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISTKPPYKERKDELK

SEQ ID NO: 87 - protein, 583 aa, Unknown
  Description of Unknown: Cholix sequence
CSLTPEPGKPIQSQLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERAGGEDETVIGWDMAIHAVAIPS

SEQ ID NO: 88 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 89 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 90 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLIPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPS

SEQ ID NO: 91 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITDVIGHSLPLRNEAFTGPESAGGEDETVIGWDMAIHAVAIPS

SEQ ID NO: 92 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVALNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 93 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAIMVKQGIEQKPVEQRIHFSKKNAMEALAAHRVCGVPLETLARSRKPRYLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPS

SEQ ID NO: 94 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKDGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSAIRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 95 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKDGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYLTNTPLENAEEHITQVIGHSLPLRNEAFTGPESAGGEDETVIGWDMAIHAVAIPS

SEQ ID NO: 96 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 97 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYTRIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 98 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFYPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 99 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIHAVAIPS

SEQ ID NO: 100 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPMDAIYNYITQKNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 101 - protein, 583 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 102 - protein, 583 aa, Unknown
  Description of Unknown: Cholix sequence
CSLTPELGKPIQSKLSISSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAERHITQVIGHSLPLRNEAFTGPESAGGEDETVIGWDMAIHAVAIPS

SEQ ID NO: 103 - protein, 583 aa, Unknown
  Description of Unknown: Cholix sequence
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 104 - protein, 583 aa, Unknown
  Description of Unknown: Cholix sequence
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 105 - protein, 583 aa, Unknown
  Description of Unknown: Cholix sequence
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 106 - protein, 583 aa, Unknown
  Description of Unknown: Cholix sequence
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPS

SEQ ID NO: 107 - protein, 583 aa, Unknown
  Description of Unknown: Cholix sequence
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPS

SEQ ID NO: 108 - protein, 583 aa, Unknown
  Description of Unknown: Cholix sequence
CSLTPELGKPIQSKLSIPSDVVLDEGVLYYSMTINDDQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQNIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 109 - protein, 582 aa, Unknown
  Description of Unknown: Cholix sequence
CSLTPEPGKPIQSKLSIPSDVVLDEGVLYYSMTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAHKNGSRHKRWANWLTTLPKVVLCFFEDPELCTYGEDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTLLENAEEHITQVIGHSLPLRNEAFTGPESAGGEDETVIGWDMAIHAVAIPS

SEQ ID NO: 110 - protein, 577 aa, Unknown
  Description of Unknown: Cholix sequence
CSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 111 - protein, 577 aa, Unknown
  Description of Unknown: Cholix sequence
CSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHAAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPS

SEQ ID NO: 112 - protein, 577 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 113 - protein, 577 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQAPEVAERLSDLRRINEDNPGMVTQVLTVARQIYNDYVTHHPGLTPEQTSAGAQAADILSLFCPDADKSCVASNNDQANINIESRSGRSYLPENRAVITPQGVTNWTYQELETTHQALTREGYVFVGYHGTNHVAAQTIVNRIAPVPRGNNTENEEKWGGLYVATHAEVAHGYARIKEGTGEYGLPTRAERETRGVMLRVYIPRASLERFYRTNTPLENAEEHITQVIGHSLPLRNEAFTGPESAGGEDETVIGWDMAIHAVAIPS

SEQ ID NO: 114 - protein, 577 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIYAVAIPS

SEQ ID NO: 115 - protein, 577 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGIPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPS

SEQ ID NO: 116 - protein, 577 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEEPELCTYGEDWHGGAYKTVAGTPGAITVKQGIEQKTVEQRIHFSKGNAMSALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 117 - protein, 577 aa, Unknown
  Description of Unknown: Cholix sequence
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQKRNIIEVPKLYSIDLDNQTLEQWENQGNVSFAVTRPEQSIAISWPSVSYKAAHKNGSRHKRWANWLTTLPKVVLCFYEEPELCTYGEDWHGGAYKTVAGTPEAITVKQGIEQKTVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 118 - protein, 577 aa, Unknown
  Description of Unknown: Cholix sequence
CSLTPEPGKPIQSKLSIPSDVVLDEGVLYYSMTINDEQNDIKDEDKGESIIIIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRVVITPQGVTNWTYQELDATHQALTREDYVFVGYHGTNHVAAQTIVNRIAPVPRGNNTENEEKWGGLYVATHAEVAHGYARIKEGTGEYGLPTRAERETRGVMLRVYIPRASLERFYRTNTPLENAEEHITQVIGHSLPLRNEAFTGPESAGGEDETVIGWDMAIHAVAIPS

SEQ ID NO: 119 - protein, 577 aa, Unknown
  Description of Unknown: Cholix sequence
CSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPS

SEQ ID NO: 120 - protein, 577 aa, Unknown
  Description of Unknown: Cholix sequence
CSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSASAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPS

SEQ ID NO: 121 - protein, 531 aa, Unknown
  Description of Unknown: Cholix sequence
VEDELNIFDECRSPCSLTPEPGKQIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCVYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEKKWGGLYVATHAEVAHGYARIKEGTGEYGLPTRAERDARGVMLRV

SEQ ID NO: 122 - protein, 491 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAEKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLLCPDADGSCVASNSDQANINIESRSGRSYLPENRAVITPQGVTNWTYQELEAKHQTLTREGYVFVGYHGTNHVAAQSIVNRITPVPRGNNTEKEEEWGG

SEQ ID NO: 123 - protein, 491 aa, Unknown
  Description of Unknown: Cholix sequence
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAEKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGG

SEQ ID NO: 124 - protein, 488 aa, Unknown
  Description of Unknown: Cholix sequence
YSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSNGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 125 - protein, 459 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQKRNIIEVPKLYSIDLDNQTLEQWENQGNVSFAVTRPEQSIAISWPSVSYKAAHKNGSRHKRWANWLTTLPKVVLCFYEEPELCTYGEDWHGGAYKTVAGTPEAITVKQGIEQKTVEQRIHFSKKNAMEALAAHRVCGVPLETLARSRKPRDLQDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHV

SEQ ID NO: 126 - protein, 415 aa, Unknown
  Description of Unknown: Cholix sequence
VEEALNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIES

SEQ ID NO: 127 - protein, 318 aa, Unknown
  Description of Unknown: Cholix sequence
LFSHLDSVFTLNLHEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 128 - protein, 208 aa, Unknown
  Description of Unknown: Cholix sequence
AVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 129 - protein, 207 aa, Unknown
  Description of Unknown: Cholix sequence
AVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDEL

SEQ ID NO: 130 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 131 - protein, 644 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 132 - protein, 639 aa, Unknown
  Description of Unknown: Cholix sequence
VEDELNIFDECRSPCSLTPEPGKPIQSKLSIPSDVVLDEGVLYYSMTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 133 - protein, 639 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYERLTPAEEAVVKEAIAKEQSISAKPPYKEQKDELK

SEQ ID NO: 134 - protein, 639 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYERLTPAEEAVVKEAIAKEQSISAKPPYKEQKDELK

SEQ ID NO: 135 - protein, 634 aa, Unknown
  Description of Unknown: Cholix sequence
VEDELNIFDECRSPCSLTPEPGKQIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCVYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEKKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 136 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 137 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVSTHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 138 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCVYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEKKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 139 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIHRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 140 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 141 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLIPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 142 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLIPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 143 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRMLFSHLDSVFTLNLDEQEPEVAERLSALRQINENNPGMVTQVLTVARQIYNDYVTHHPGLIPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 144 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARLKKGTGNAELPTRAERDARGVMLRVYIPRASLERFYRTNTPLENAEEHITHVIGHSLPLRNEAFTGPERVDGEDETVIGWDMAIHAVAIPSTIPGNAYEVLAIDEEAVAEEQSISAKPPYKERKDELK

SEQ ID NO: 145 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVFFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVTERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIHRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 146 - protein, 634 aa, Unknown
  Description of Unknown: Cholix sequence
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 147 - protein, 649 aa, Artificial Sequence
  Description of Artificial Sequence: Synthetic polypeptide
  MOD_RES (1)..(1): V or L
  MOD_RES (3)..(3): E or D
  MOD_RES (4)..(4): A or E
  MOD_RES (6)..(6): N or K
  MOD_RES (16)..(16): S or L
  MOD_RES (21)..(21): P or L
  MOD_RES (24)..(24): P or Q
  MOD_RES (30)..(30): S or F
  MOD_RES (33)..(33): S or G
  MOD_RES (56)..(56): K or M
  MOD_RES (59)..(59): D or G
  MOD_RES (67)..(67): I or F
  MOD_RES (73)..(73): V or I
  MOD_RES (81)..(81): N or S
  MOD_RES (90)..(90): H or N
  MOD_RES (101)..(101): T or M
  MOD_RES (104)..(104): Y or F
  MOD_RES (108)..(108): E or D
  MOD_RES (109)..(109): G or S
  MOD_RES (112)..(112): A or T
  MOD_RES (114)..(114): N or H
  MOD_RES (118)..(118): P or I
  MOD_RES (119)..(119): I or P
  MOD_RES (131)..(131): V or I
  MOD_RES (134)..(134): L or I
  MOD_RES (137)..(137): Q or K
  MOD_RES (160)..(160): K or E
  MOD_RES (161)..(161): T or N
  MOD_RES (166)..(166): S or F
  MOD_RES (168)..(168): S or A
  MOD_RES (174)..(174): H or Q
  MISC_FEATURE (175)..(185): This region may encompass "N", "S", "SIAKQS", or "SIAKQSIAKQS"
  MOD_RES (196)..(196): K or N
  MOD_RES (199)..(199): Q, E, or H
  MOD_RES (201)..(201): E, N, or D
  MOD_RES (203)..(203): S or A
  MOD_RES (210)..(210): H or N
  MOD_RES (212)..(212): H, L, F, or R
  MOD_RES (214)..(214): G or T
  MOD_RES (215)..(215): L or S
  MOD_RES (216)..(216): A or P
  MOD_RES (217)..(217): L, E, or K
  MOD_RES (218)..(218): C or V
  MOD_RES (219)..(219): W, V, or T
  MOD_RES (221)..(221): V or not present
  MOD_RES (222)..(222): P or not present
  MOD_RES (223)..(223): M, I, L, or not present
  MOD_RES (224)..(224): D or not present
  MOD_RES (225)..(225): A or not present
  MOD_RES (226)..(226): I or not present
  MOD_RES (227)..(227): Y or C
  MOD_RES (228)..(228): N or F
  MOD_RES (229)..(229): Y or F
  MOD_RES (230)..(230): I or E
  MOD_RES (231)..(231): T or D
  MOD_RES (232)..(232): Q or P
  MOD_RES (233)..(233): Q, E, or A
  MOD_RES (234)..(234): N, L, or Q
  MOD_RES (237)..(237): L or Y
  MOD_RES (239)..(239): D or E
  MOD_RES (240)..(240): N or D
  MOD_RES (242)..(242): F, H, or Y
  MOD_RES (245)..(245): S or A
  MOD_RES (247)..(247): E or K
  MOD_RES (252)..(252): T or I
  MOD_RES (254)..(254): K, E, or G
  MOD_RES (255)..(255): V or A
  MOD_RES (257)..(257): T or M
  MOD_RES (262)..(262): I or M
  MOD_RES (266)..(266): P, T, or A
  MOD_RES (275)..(275): K, Q, or N
  MOD_RES (276)..(276): G or K
  MOD_RES (279)..(279): M or I
  MOD_RES (280)..(280): S or E
  MOD_RES (281)..(281): A or T
  MOD_RES (298)..(298): S or G
  MOD_RES (303)..(303): D or Y
  MOD_RES (305)..(305): T, P, or Q
  MOD_RES (309)..(309): S or Q
  MOD_RES (311)..(311): A or V
  MOD_RES (313)..(313): Q or N
  MOD_RES (316)..(316): N or Q
  MOD_RES (322)..(322): V or L
  MOD_RES (326)..(326): I or M
  MOD_RES (329)..(329): S or T
  MOD_RES (331)..(331): L or I
  MOD_RES (334)..(334): V or I
  MOD_RES (340)..(340): D, E, or H
  MOD_RES (341)..(341): E or G
  MOD_RES (343)..(343): E or A
  MOD_RES (345)..(345): E or A
  MOD_RES (347)..(347): A or T
  MOD_RES (351)..(351): S, D, or T
  MOD_RES (352)..(352): D or A
  MOD_RES (353)..(353): L or I
  MOD_RES (355)..(355): R or Q
  MOD_RES (359)..(359): N or D
  MOD_RES (363)..(363): M or V
  MOD_RES (365)..(365): T or I
  MOD_RES (370)..(370): V or I
  MOD_RES (381)..(381): H or E
  MOD_RES (384)..(384): G or L
  MOD_RES (386)..(386): T or I
  MOD_RES (393)..(393): G or S
  MOD_RES (403)..(403): F or L
  MOD_RES (404)..(404): C or Y
  MOD_RES (407)..(407): A or T
  MOD_RES (409)..(409): K, E, or G
  MOD_RES (410)..(410): S, P, or H
  MOD_RES (414)..(414): S or L
  MOD_RES (415)..(415): N or D
  MOD_RES (416)..(416): N or S
  MOD_RES (423)..(423): I or V
  MOD_RES (433)..(433): P or L
  MOD_RES (441)..(441): P or Q
  MOD_RES (453)..(453): E or D
  MOD_RES (454)..(454): A or T
  MOD_RES (455)..(455): T or K
  MOD_RES (458)..(458): A or T
  MOD_RES (461)..(461): R or Q
  MOD_RES (463)..(463): G or D
  MOD_RES (475)..(475): V or A
  MOD_RES (479)..(479): T, S, or N
  MOD_RES (485)..(485): A, S, or T
  MOD_RES (491)..(491): N or S
  MOD_RES (492)..(492): N or D
  MOD_RES (495)..(495): N, S, or K
  MOD_RES (497)..(497): E, R, or K
  MOD_RES (498)..(498): K, A, or E
  MOD_RES (502)..(502): L or V
  MOD_RES (505)..(505): A or S
  MOD_RES (507)..(507): H or D
  MOD_RES (509)..(509): E or S
  MOD_RES (510)..(510): V or L
  MOD_RES (511)..(511): A or N
  MOD_RES (512)..(512): H or Y
  MOD_RES (513)..(513): G or R
  MOD_RES (515)..(515): A or T
  MOD_RES (517)..(517): I or L
  MOD_RES (518)..(518): K or Q
  MOD_RES (519)..(519): E or K
  MOD_RES (522)..(522): G or A
  MOD_RES (523)..(523): E, D, or N
  MOD_RES (524)..(524): Y, G, A, or N
  MOD_RES (525)..(525): G or E
  MOD_RES (526)..(526): L or G
  MOD_RES (527)..(527): P or L
  MOD_RES (529)..(529): R, P, or T
  MOD_RES (530)..(530): A or E
  MOD_RES (531)..(531): E or K
  MOD_RES (532)..(532): R, Q, or K
  MOD_RES (533)..(533): D, K, or E
  MOD_RES (534)..(534): A, T, or S
  MOD_RES (540)..(540): R or K
  MOD_RES (543)..(543): I or L
  MOD_RES (544)..(544): P or H
  MOD_RES (545)..(545): R or Q
  MOD_RES (554)..(554): T or I
  MOD_RES (556)..(556): T, A, or I
  MOD_RES (557)..(557): P or D
  MOD_RES (560)..(560): N or K
  MOD_RES (561)..(561): A or E
  MOD_RES (562)..(562): E, R, or D
  MOD_RES (563)..(563): E, N, or R
  MOD_RES (564)..(564): H or L
  MOD_RES (565)..(565): I or V
  MOD_RES (566)..(566): T or E
  MOD_RES (567)..(567): Q, R, H, or D
  MOD_RES (572)..(572): S or P
  MOD_RES (583)..(583): P or T
  MOD_RES (584)..(584): E or D
  MOD_RES (585)..(585): S, A, or R
  MOD_RES (586)..(586): A, E, or V
  MOD_RES (587)..(587): G, E, or D
  MOD_RES (589)..(589): E or S
  MOD_RES (590)..(590): D or N
  MOD_RES (593)..(593): V or A
  MOD_RES (598)..(598): M or I
  MOD_RES (601)..(601): H or Y
  MOD_RES (602)..(602): A or G
  MOD_RES (613)..(613): A or S
  MOD_RES (615)..(615): E or A
  MOD_RES (616)..(616): E, A, Q, G, V, or R
  MOD_RES (618)..(618): A, P, or T
  MOD_RES (619)..(619): I, T, or P
  MOD_RES (620)..(620): D or A
  MISC_FEATURE (624)..(629): This region may encompass "V" or "VVKEAI"
  MOD_RES (631)..(631): K or E
  MOD_RES (637)..(637): T, A, or P
  MOD_RES (644)..(644): R, Q, or H
  MOD_RES (645)..(645): K or not present
XEXXLXIFDECRSPCXLTPEXGKXIQSKLXIPXDVVLDEGVLYYSMTINDEQNDIXDEXKGESIITXGEFATXRATRHYVXQDAPFGVIXLDITTENGTKXYSXNRKXXEFXIXWLVXXGEDSPASIKISXDEXDQXRNIIEVPKLYSIDLDNQTLEQWXXQGNVXFXVTRPEXXXXXXXXXXXXIAISWPSVSYXAAXKXGXRHKRWAXWXTXXXXXXLXXXXXXXXXXXXXXCTXGXXWXGGXYXTVAGXPXXIXVKQGXEQKXVEQRIHFSXXNAXXXLAAHRVCGVPLETLARXRKPRXLXDDLXCXYXAQXIVSLFXATRXLFXHXDSXFTLNLXXQXPXVXERLXXXRXINEXNPGXVXQVLTXARQIYNDYVTXHPXLXPEQTSAXAQAADILSLXXPDXDXXCVAXXXDQANINXESRSGRSYLXENRAVITXQGVTNWTYQELXXXHQXLTXEXYVFVGYHGTNHXAAQXIVNRIXPVPRGXXTEXEXXWGGXYVXTXAXXXXXYXRXXXGTXXXXXXTXXXXXXRGVMLXVYXXXASLERFYRXNXXLEXXXXXXXXVIGHXLPLRNEAFTGXXXXXGXXETXIGWDXAIXXVAIPSTIPGNXYXXLXXXEEAXXXXXXAXEQSISXKPPYKEXXDELK

SEQ ID NO: 148 - protein, 6 aa, Artificial Sequence
  Description of Artificial Sequence: Synthetic peptide
SIAKQS

SEQ ID NO: 149 - protein, 11 aa, Artificial Sequence
  Description of Artificial Sequence: Synthetic peptide
SIAKQSIAKQS

SEQ ID NO: 150 - protein, 6 aa, Artificial Sequence
  Description of Artificial Sequence: Synthetic peptide
VVKEAI

SEQ ID NO: 151 - protein, 30 aa, Artificial Sequence
  Description of Artificial Sequence: Synthetic polypeptide
  MISC_FEATURE (1)..(30): This sequence may encompass 1-15 "Gly Ser" repeating units
GSGSGSGSGSGSGSGSGSGSGSGSGSGSGS

SEQ ID NO: 152 - protein, 45 aa, Artificial Sequence
  Description of Artificial Sequence: Synthetic polypeptide
  MISC_FEATURE (1)..(45): This sequence may encompass 1-15 "Gly Gly Ser" repeating units
GGSGGSGGSGGSGGSGGSGGSGGSGGSGGSGGSGGSGGSGGSGGS

SEQ ID NO: 153 - protein, 214 aa, Artificial Sequence
  Description of Artificial Sequence: Synthetic polypeptide
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 154 - protein, 224 aa, Artificial Sequence
  Description of Artificial Sequence: Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 155 - protein, 214 aa, Artificial Sequence
  Description of Artificial Sequence: Synthetic polypeptide
DILLTQSPAILSVSPGERVSFSCRASQFVGSSIHWYQQRTNGSPRLLIKYASESMSGIPSRFSGSGSGTDFTLSINTVESEDIADYYCQQSHSWPFTFGSGTNLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 156 - protein, 226 aa, Artificial Sequence
  Description of Artificial Sequence: Synthetic polypeptide
EVKLEESGGGLVQPGGSMKLSCVASGFIFSNHWMNWVRQSPEKGLEWVAEIRSKSINSATHYAESVKGRFTISRDDSKSAVYLQMTDLRTEDTGVYYCSRNYYGSTYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

What is claimed is:

1. A solid pharmaceutical composition suitable for oral administration to a subject in need thereof, the pharmaceutical composition comprising:

a plurality of delivery constructs; and one or more pharmaceutically acceptable excipients, wherein each of the delivery constructs comprises an amino acid sequence set forth in SEQ ID NO: 5 or SEQ ID NO: 13, wherein at least 80% of the delivery constructs are in a dimer form, wherein at least one of the one or more pharmaceutically acceptable excipients is a surfactant, wherein the surfactant comprises a poloxamer;

wherein the pharmaceutical composition is formulated as an oral dosage form, the oral dosage form comprising (1) a first coat comprising two or more copolymers each having a different dissolution pH and (2) another coat interior to the first coat and exterior to the delivery constructs and the one or more pharmaceutically acceptable excipients; and wherein a first copolymer of the first coat comprises a polymer of formula I:

Formula I

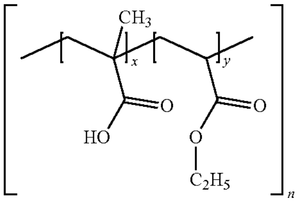

wherein x, y, and n are each greater than or equal to one; and wherein a second copolymer of the first coat comprises a copolymer of formula II:

Formula II

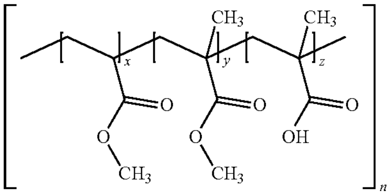

;

wherein x, y, z, and n are each greater than or equal to one.

2. The pharmaceutical composition of claim 1, wherein the poloxamer is a poloxamer 188.

3. The pharmaceutical composition of claim 1, wherein the one or more pharmaceutically acceptable excipients does not include a polysorbate.

4. The pharmaceutical composition of claim 1, wherein the one or more pharmaceutically acceptable excipients comprises a non-ionic lubricant.

5. The pharmaceutical composition of claim 4, wherein the non-ionic lubricant is glyceryl behenate.

6. The pharmaceutical composition of claim 1, wherein the one or more pharmaceutically acceptable excipients does not include a magnesium stearate.

7. The pharmaceutical composition of claim 1, wherein the pharmaceutical composition is configured to release substantially none of the plurality of delivery constructs after a 1-hour exposure to a solution having a pH of 1.0 in a Type 4 dissolution apparatus in open mode, wherein the solution having the pH of 1.0 is a dissolution media containing hydrochloric acid.

8. The pharmaceutical composition of claim 1, wherein the pharmaceutical composition is configured to release at least 40% of the delivery construct after 2 hours of exposure to a solution having a pH of 7.0 in a Type 4 dissolution apparatus in open mode, wherein the solution having the pH of 7.0 is a citrate/phosphate buffer.

9. The pharmaceutical composition of claim 1, wherein a ratio of free carboxyl groups to ester groups in the first copolymer is from 0.8:1 and 1.2:1 and wherein a ratio of free carboxyl groups to ester groups in the second copolymer is from 0.8:1 to 1.2:1.

10. The pharmaceutical composition of claim 1, wherein a ratio of the first copolymer of the first coat to the second copolymer of the first coat is from 15:85 to 55:45.

11. The pharmaceutical composition of claim 1, wherein the ratio of the first copolymer to the second copolymer is to 30:70.

12. The pharmaceutical composition of claim 1, wherein the first coat further comprises an anti-tacking agent, a plasticizer, a surfactant, or a combination thereof.

13. The pharmaceutical composition of claim 1, further comprising an additional coat exterior to the first coat.

14. The pharmaceutical composition of claim 13, wherein the additional coat exterior to the first coat comprises hydroxypropylmethylcellulose (HPMC).

15. The pharmaceutical composition of claim 1, wherein the another coat comprises HPMC.

16. The pharmaceutical composition of claim 1, wherein the oral formulation is in a tablet or a capsule form.

17. The pharmaceutical composition of claim 1, wherein the oral formulation is in a unit dose form.

18. The pharmaceutical composition of claim 17, wherein the first coat has a mass from 10 mg to 100 mg per unit dose form.

19. The pharmaceutical composition of claim 17, wherein the plurality of delivery constructs are present in an amount from 1 mg to 20 mg per unit dose of the formulation.

20. A method of treating an inflammatory disease in a subject, the method comprising administering to the subject an effective amount of an oral formulation comprising the pharmaceutical composition of claim 1.

21. The method of claim 20, wherein the inflammatory disease is ulcerative colitis, proctitis, pouchitis, Crohn's disease, multiple sclerosis (MS), systemic lupus erythematosus (SLE), graft versus host disease (GVHD), rheumatoid arthritis, inflammatory bowel disease (IBD), celiac disease, psoriatic arthritis, or psoriasis.

22. The method of claim 20, wherein the administration of the dose of the oral formulation to the subject results in an immunomodulatory response selected from the group consisting of:

(i) a decrease in a concentration of fecal calprotectin (FCP) relative to an FCP baseline concentration level present in the subject prior to administration, (ii) a decrease in a concentration of C-reactive protein (CRP) relative to a CRP baseline concentration level present in the subject prior to administration, (iii) a decrease in a Geboes score relative a Geboes score baseline present in the subject prior to administration, or (iv) a combination of any one of (i) (iii).

23. The method of claim 21, wherein the inflammatory disease is ulcerative colitis.

24. The method of claim 21, wherein the inflammatory disease is rheumatoid arthritis.

25. The method of claim 21, wherein the inflammatory disease is pouchitis.

* * * * *